(12) United States Patent
Kieliszewski et al.

(10) Patent No.: US 8,962,811 B2
(45) Date of Patent: Feb. 24, 2015

(54) GROWTH HORMONE AND INTERFERON-ALPHA 2 GLYCOPROTEINS PRODUCED IN PLANTS

(71) Applicant: Ohio University, Athens, OH (US)

(72) Inventors: Marcia J. Kieliszewski, Albany, OH (US); Jianfeng Xu, Athens, OH (US); John Kopchick, Athens, OH (US); Shigeru Okada, Athens, OH (US); Gary Meyer, Albany, OH (US)

(73) Assignee: Ohio University, Athens, OH (US)

( * ) Notice: Subject to any disclaimer, the term of this patent is extended or adjusted under 35 U.S.C. 154(b) by 0 days.

(21) Appl. No.: 13/855,946

(22) Filed: Apr. 3, 2013

(65) Prior Publication Data

US 2014/0024806 A1      Jan. 23, 2014

Related U.S. Application Data

(63) Continuation of application No. 13/005,715, filed on Jan. 13, 2011, now abandoned, which is a continuation of application No. 12/117,692, filed on May 8, 2008, now abandoned, which is a continuation of application No. 11/036,257, filed on Jan. 14, 2005, now abandoned.

(60) Provisional application No. 60/602,562, filed on Aug. 18, 2004, provisional application No. 60/582,027, filed on Jun. 22, 2004, provisional application No. 60/536,486, filed on Jan. 14, 2004.

(51) Int. Cl.

| | |
|---|---|
| *C07K 14/00* | (2006.01) |
| *A61K 38/21* | (2006.01) |
| *A61K 38/27* | (2006.01) |
| *C07K 14/415* | (2006.01) |
| *C07K 14/61* | (2006.01) |
| *C07K 14/765* | (2006.01) |
| *C12N 15/62* | (2006.01) |
| *C12N 15/82* | (2006.01) |
| *C12P 21/00* | (2006.01) |
| *C07K 14/56* | (2006.01) |

(52) U.S. Cl.
CPC .............. *C07K 14/415* (2013.01); *A61K 38/27* (2013.01); *C07K 14/61* (2013.01); *C07K 14/765* (2013.01); *C12N 15/62* (2013.01); *C12N 15/8257* (2013.01); *C12P 21/005* (2013.01); *C07K 14/56* (2013.01)
USPC ........... 530/395; 530/300; 530/350; 530/351; 530/397; 424/85.4; 424/192.1; 424/195.11; 436/87

(58) Field of Classification Search
None
See application file for complete search history.

(56) References Cited

U.S. PATENT DOCUMENTS

| 6,033,895 | A | * | 3/2000 | Garger et al. ................. 435/239 |
| 8,563,687 | B2 | | 10/2013 | Kieliszewski |
| 8,623,812 | B2 | | 1/2014 | Kieliszewski |

FOREIGN PATENT DOCUMENTS

| EP | 1711533 B1 | 12/2013 |
| EP | 2133427 B1 | 12/2013 |
| WO | WO/01/78503 | * 10/2001 |

OTHER PUBLICATIONS

Ma et al.—The production of recombinant pharmaceutical proteins in plants, Nature Reviews. Genetics. 4, 794-805, 2003.*
Shpak et al., Synthetic genes for glycoprotein design and the elucidation of hydroxyproline-O-glycosylation codes. PNAS, 96, 14736-14741, 1999.*
Wells, Biochemistry 29:8509-8517, 1990.*
Ngo et al., The Protein Folding Problem and Tertiary Structure Prediction, Merz& Le Grand Editors, BirkHauser Boston, pp. 492-495, 1994.*
Skolnick et al., Trends in Biotech. 18(1):34-39, 2000.*
Bork et al., Trends in Genetics 12:425-427, 1996.*
Shpak et al. PNAS, 96, 14736-14741, 1999.*
Sundström et al. , Crystal Structure of an Antagonist Mutant of Human Growth Hormone, G120R, in Complex with Its Receptor at 2.9 Å Resolution, J. Biol. Chem., 271, 32197-32203, 1996.*
Notice of Allowance in U.S. Appl. No. 11/568,102 mailed Jul. 29, 2013 (3 pages).
Notice of Allowance in U.S. Appl. No. 12/820,943 mailed Sep. 6, 2013 (8 pages).
Notice of Allowance in U.S. Appl. No. 12/820,943 mailed May 30, 2013 (8 pages).
Office Action in U.S. Appl. No. 12/820,943 mailed Oct. 15, 2012 (6 pages).
Office Action in U.S. Appl. No. 13/019,819 mailed Jun. 19, 2013 (15 pages).
Office Action in U.S. Appl. No. 13/019,819 mailed Nov. 13, 2012 (15 pages).
CA 2,573,918—Office Action, dated Jan. 25, 2013 (2 pages).
CA 2,553,257—Office Action, dated Mar. 25, 2013 (2 pages).
EP 98 944 431.0—Further Examination Report dated Apr. 2, 2013 (4 pages).
EP 98 944 431.0—Further Examination Report dated Aug. 28, 2012 (4 pages).
EP 98 944 431.0—Examination Report, dated Aug. 7, 2012 (4 pages).
EP 05 726 258.6—Notice of Grant, mailed Jul. 17, 2013 (5 pages).
EP 05 726 258.6—Summons to Attend Oral Proceedings, mailed Nov. 19, 2012 (5 pages).
EP 05 779 913.2—Examination Report, mailed Feb. 21, 2013 (3 pages).
EP 09 004 742.4—Notice of Grant, mailed Jul. 25, 2013 (7 pages).
EP 09 004 742.4—Summons to Attend Oral Proceedings, mailed Nov. 16, 2012 (6 pages).
IL 176781—Official Action, mailed Aug. 5, 2013 (6 pages).
JP 2006-549613—Decision of Rejection, mailed Nov. 28, 2012 (2 pages).

(Continued)

*Primary Examiner* — Elly-Gerald Stoica
(74) *Attorney, Agent, or Firm* — Dinsmore & Shohl LLP

(57) ABSTRACT

Methods of increasing the yield in plant expression of recombinant proteins comprising engineering glycosylation sites into cloned genes or cDNAs for proteins using codons that drive post-translational modifications in plants; and engineering the cloned genes or cDNAs to contain a plant secretory signal sequence that targets the gene products (protein) for secretion. The methods result in increased recombinant glycosylated protein yields. Proteins produced according to these methods are disclosed.

20 Claims, 42 Drawing Sheets

(56) References Cited

OTHER PUBLICATIONS

Furuhashi et al., "Fusing the Carboxy-Terminal Peptide of the Chorionic Gonadotropin (CG) Beta-Subunit to the Common Alpha-Subunit: Retention of O-Linked Glycosylation and Enhanced In Vivo Bioactivity of Chimeric Human CG," Mol. Endocrinology (1995), vol. 9, No. 1, pp. 54-63.

Leonard, Renaud, et al., "Two Novel Types of O-Glycans on the Mugwort Pollen Allergen Art v 1 and Their Role in Antibody Binding," J. Biol. Chem., vol. 280, No. 9, pp. 7932-7940 (2005).

Nishi, Tatsumari., "Qualitative Improvements of Therapeutic Glycoproteins by Glycotechnology", (1992), vol. 4 No. 16, pp. 336-344.

Tsumuraya, Yoichi et al., "Arabinogalactan-Proteins from Primary and Mature Roots of Radish (*Raphanus sativus* L.)," Plant Physiol. (1988) 86, 0155-0160.

Wilson, Iain BH, "Glycosylation of Proteins in Plants and Invertebrates," Curr Opin Struct Biol. Oct. 2002;12 (5):569-77.

Notice of Reasons for Rejection dated Aug. 28, 2014 pertaining to Japanese Patent Application Serial No. 2013-065541 filed Mar. 27, 2013.

Official Communication dated Jul. 23, 2014 pertaining to Israeli Patent Application Serial No. 176781 filed Jan. 14, 2005.

Non-Final Office Action dated Jan. 7, 2014 pertaining to U.S. Appl. No. 13/149,016, filed May 31, 2011.

Final Office Action dated Feb. 18, 2014 pertaining to U.S. Appl. No. 13/019,819, filed Feb. 2, 2011.

Notice of Allowance dated Jun. 30, 2014 pertaining to U.S. Appl. No. 13/149,016, filed May 31, 2011.

Summons to Attend Oral Proceedings dated May 9, 2014 pertaining to related European Application Serial No. 98944431.0.

Notice of Allowance pertaining to U.S. Appl. No. 13/019,819, filed Feb. 2, 2011.

\* cited by examiner (a)

*HindIII   BspEI*     *BsrFI*
5'-TAAAAGCTTCCGGAGTGCCGGCCCTCATAGCCCACCTCCACCATTATCACCATCACCTACTCCAACTCC
TCCTTTGGGACCACACAG-3'

*EcoRI    AgeI     XmaI*
5'-AATAGAATTCCACCGGTACCCCGGGAGGTGGTGTTGCGGTTGGTGAACGCGAAAGTGTAGCGCGTGGA
CTGTGTGGTCCCAAAGGA-3'

(b)

*HindIII   AgeI    BspEI*
5'-TTCAAGCTTACCGGTCTCCGGAACACCATTACCCACTTTGACCCCACTTCCTGCCCCAACT-3'

*EcoRI   NcoI     XmaI*
5'-TGAGAATTCCATGGTCCGCCCGGGGTGTGGTAAAAGAGGTGGAGTTGGGGCAGGAAGTGGGGT -3'

FIGURE 1

(a)
```
                BamHI
5'-CTGACAGAGGATCCGCAATGGGAAAA ATG GCT TCT CTA TTT GCC ACA TTT TTA GTC CTT
                              M   A   S   L   F   A   T   F   L   V   V
                       XmaI
TTA GTG TCA CTT AGC TTA GCA CAA ACA ACC CGG GAC [TCA CCC TCA CCA ACT CCT
 L   V   S   L   S   L   A   Q   T   T   R   D  [ S   P   S   P   T   P
                                                                    AgeI
ACC GCA CCA CCT GGT CCA CAC TCA CCA CCA CCA ACA TTG]₃TCA CCC TCA CCG GTC
 T   A   P   P   G   P   H   S   P   P   P   T   L ]₃ S   P   S   P   V
    NcoI                BsrGI                               SacI
GCC ACC ATG GTG-EGFP-CTG TAC AAG TAA AGCGGCCGCCACCGCGGAGGAGCTCGAATCG-3'
 A   T   M   V        L   Y   K  Stop
```

(b)
```
                BamHI
5'-CTGACAGAGGATCCGCAATGGGAAAA ATG GCT TCT CTA TTT GCC ACA TTT TTA GTG GTT
                              M   A   S   L   F   A   T   F   L   V   V
                                                    BsrFI
TTA GTG TCA CTT AGC TTA GCA CAA ACA ACC CGG AGT GCC [GGC CCT CAT AGC CCA
 L   V   S   L   S   L   A   Q   T   T   R   S   A  [ G   P   H   S   P

CCT CCA CCA TTA TCA CCA TCA CCT ACT CCA ACT CCT CCT TTG GGA CCA CAC AGT
 P   P   P   L   S   P   S   P   T   P   T   P   P   L   G   P   H   S
                                                           XmaI    AgeI
CCA CCC CCT ACA CTT TCC CCT TCA CCA ACC CCA ACA CCA CCT CCC]ₙGGG GTA CCG
 P   P   P   T   L   S   P   S   P   T   P   T   P   P   P ]ₙ G   V   P
    NcoI                BsrGI                               SacI
GTC ACC ATG GTG-EGFP-CTG TAC AAG TAA AGCGGCCGCCACCGCGGAGGAGCTCGAATCG-3'
 V   T   M   V        L   Y   K  Stop                         (n=4, 10)
```

FIGURE 2

```
                 BamHI
5'-CTGACAGAGGATCCGCAATGGGAAAA ATG GCT TCT CTA TTT GCC ACA TTT TTA GTG GTT
                              M   A   S   L   F   A   T   F   L   V   V
                                          XmaI        AgeI        BspEI
TTA GTG TCA CTT AGC TTA GCA CAA ACA ACC CGG GAC TCA CCG GTC TCC [GGA ACA
 L   V   S   L   S   L   A   Q   T   T   R   D   S   P   V   S   G   T

CCA TTA CCC ACT TTG ACC CCA CTT CCT GCC CCA ACT CCA CCT CTT TTA CCA CAC
 P   L   P   T   L   T   P   L   P   A   P   T   P   P   L   L   P   H
  XmaI          NcoI              BsrGI                            SacI
CCC]ₙGGG CGG ACC ATG GTG-EGFP-CTG TAC AAG TAA AGCGGCCGCCACCGCGGAGGAGCTCG
 P ]ₙ G   R   T   M   V       L   Y   K  Stop AATCG-3'                                                          (n=4,8)
```

FIGURE 3

```
                BamHI
5'CTGACAGAGGATCCGCAATGGGAAAA ATG GCT TCT CTA TTT GCC ACA TTT TTA GTG GTT
                              M   A   S   L   F   A   T   F   L   V   V
                                                      BsrFI
TTA GTG TCA CTT AGC TTA GCA CAA ACA ACC CGG AGT GCC [GGC CCT CAT AGC CCA
 L   V   S   L   S   L   A   Q   T   T   R   S   A  [ G   P   H   S   P

CCT CCA CCA TTA TCA CCA TCA CCT ACT CCA ACT CCT CCT TTG GGA CCA CAC AGT
 P   P   P   L   S   P   S   P   T   P   T   P   P   L   G   P   H   S
                                                            XmaI      AgeI
CCA CCC CCT ACA CTT TCC CCT TCA CCA ACC CCA ACA CCA CCT CCC]4GGG GTA CCG
 P   P   P   T   L   S   P   S   P   T   P   T   P   P   P ]4 G   V   P

GTC TCC [GGA ACA CCA TTA CCC ACT TTG ACC CCA CTT CCT GCC CCA ACT CCA CCT
 V   S  [ G   T   P   L   P   T   L   T   P   L   P   A   P   T   P   P
              XmaI          NcoI          BsrGI
CTT TTA CCA CAC CCC]nGGG CGG ACC ATG GTG-EGFP-CTG TAC AAG TAAAGCGGCCGCCA
 L   L   P   H   P ]n G   R   T   M   V        L   Y   K  Stop SacI
CCGCGGAGGAGCTCGAATCG-3'                                          (n=2,4)
```

FIGURE 4

The construction of hGH-(SP)₁₀-EGFP gene cassette:

The construction of HSA-(SP)₁₀ gene cassette:

The construction of DomainI-(SP)$_{10}$ gene cassette:

Human Growth Hormone (hGH)

hGH-(SP)₁₀ construct:

Gene Sequence:

```
                                                                    BamHI
                                                        5'-AGAGGATCCGCA
Tobacco signal sequence
ATG GGA AAA ATG GCT TCT CTA TTT GCC ACA TTT TTA GTG GTT TTA GTG TCA CTT AGC TTA
 M   G   K   M   A   S   L   F   A   T   F   L   V   V   L   V   S   L   S   L  (20)
                 1                                  10
GCA CAA ACA ACC TTC CCA ACC ATT CCC TTA TCC AGG CTT TTT GAC AAC GCT ATG CTC CGC
 A   Q   T   T   F   P   T   I   P   L   S   R   L   F   D   N   A   M   L   R  (40)
                21                                  30
GCC CAT CGT CTG CAC CAG CTG GCC TTT GAC ACC TAC CAG GAG TTT GAA GAA GCC TAT ATC
 A   H   R   L   H   Q   L   A   F   D   T   Y   Q   E   F   E   E   A   Y   I  (60)
                41                                  50
CCA AAG GAA CAG AAG TAT TCA TTC CTG CAG AAC CCC CAG ACC TCC CTC TGT TTC TCA GAG
 P   K   E   Q   K   Y   S   F   L   Q   N   P   Q   T   S   L   C   F   S   E  (80)
                61                                  70
TCT ATT CCG ACA CCC TCC AAC AGG GAG GAA ACA CAA CAG AAA TCC AAC CTA GAG CTG CTC
 S   I   P   T   P   S   N   R   E   E   T   Q   Q   K   S   N   L   E   L   L  (100)
                81                                  90
CGC ATC TCC CTG CTG CTC ATC CAG TCG TGG CTG GAG CCC GTG CAG TTC CTC AGG AGT GTC
 R   I   S   L   L   L   I   Q   S   W   L   E   P   V   Q   F   L   R   S   V  (120)
               101                                 110
TTC GCC AAC AGC CTG GTG TAC GGC GCC TCT GAC AGC AAC GTC TAT GAC CTC CTA AAG GAC
 F   A   N   S   L   V   Y   G   A   S   D   S   N   V   Y   D   L   L   K   D  (140)
               121                                 130
CTA GAG GAA GGC ATC CAA ACG CTG ATG GGG AGG CTG GAA GAT GGC AGC CCC CGG ACT GGG
 L   E   E   G   I   Q   T   L   M   G   R   L   E   D   G   S   P   R   T   G  (160)
               141                                 150
CAG ATC TTC AAG CAG ACC TAC AGC AAG TTC GAC ACA AAC TCA CAC AAC GAT GAC GCA CTA
 Q   I   F   K   Q   T   Y   S   K   F   D   T   N   S   H   N   D   D   A   L  (180)
               161                                 170
CTC AAG AAC TAC GGG CTG CTC TAC TGC TTC AGG AAG GAC ATG GAC AAG GTC GAG ACA TTC
 L   K   N   Y   G   L   L   Y   C   F   R   K   D   M   D   K   V   E   T   F  (200)
               181                                 190
CTG CGC ATC GTG CAG TGC CGC TCT GTG GAG GGC AGC TGT GGC TTC TCA CCC TCT CCA AGC
 L   R   I   V   Q   C   R   S   V   E   G   S   C   G   F   S   P   S   P   S  (220)
               201                                 210             BsrGI
CCT TCC CCA TCG CCT AGT CCC TCA CCA TCC CCT TCT CCC AGC CCA TAG CTG TAC AAG TAA
 P   S   P   S   P   S   P   S   P   S   P   S   P   *   L   Y   K   *  (240)
                SacI
AGCGGCCGCCACCGCGGAGGAGCTCGAATCG-3'
```

FIGURE 10A a

```
                         NcoI
Sense: 5'-TTC ACC ATG GCT TCA CCC TCT CCA AGC CCT TCC CCA TCG CCT AGT CCC-3'
                                                 3'-AGG GGT AGC GGA TCA GGG
       AGT GGT AGG GGA AGA GGG TCG GGT ATC GAC ATG TTC TAA-5'  Anti-sense
                                             BsrGI
```

Primer extension

```
        NcoI
5'-TTC ACC ATG GCT TCA CCC TCT CCA AGC CCT TCC CCA TCG CCT AGT CCC TCA
3'-AAG TGG TAC CGA AGT GGG AGA GGT TCG GGA AGG GGT AGC GGA TCA GGG AGT
             S   P   S   P   S   P   S   P   S   P   S   P   S
                                        BsrGI
   CCA TCC CCT TCT CCC AGC CCA TAG CTG TAC AAG ATT-3'
   GGT AGG GGA AGA GGG TCG GGT ATC GAC ATG TTC TAA-5'
    P   S   P   S   P   S   P   *
``` b

```
                         NcoI
Sense: 5'-TTC ACC ATG GCT TCA CCC TCT CCA AGC CCT TCC CCA TCG CCT AGT CCC-3'
                                                 3'-AGG GGT AGC GGA TCA GGG
       AGT GGT AGG GGA AGA GGG TCG GGT CTG CTA CTA CTG TTT AGG TAC CAT TAA-5' Anti-sense
                                                          NcoI
```

Primer extension

```
        NcoI
5'-TTC ACC ATG GCT TCA CCC TCT CCA AGC CCT TCC CCA TCG CCT AGT CCC AGT
3'-AAG TGG TAC CGA AGT GGG AGA GGT TCG GGA AGG GGT AGC GGA TCA GGG TCA
             S   P   S   P   S   P   S   P   S   P   S   P   S
                                                              NcoI
   CCA TCC CCA TCT CCC AGC CCA GAC GAT GAT GAC AAA TCC ATG GTA ATT-3'
   GGT AGG GGA AGA GGG TCG GGT CTG CTA CTA CTG TTT AGG TAC CAT TAA-5'
    P   S   P   S   P   S   P   D   D   D   D   K
```

FIGURE 10B hGH-(SP)₁₀ plus enhanced green fluorescent protein (EGFP)

hGH-(SP)₁₀-EGFP construct:

Gene Sequence:

```
                                                                    BamHI
                                                           5'-AGAGGATCCGCA
Tobacco signal sequence
ATG GGA AAA ATG GCT TCT CTA TTT GCC ACA TTT TTA GTG GTT TTA GTG TCA CTT AGC TTA
 M   G   K   M   A   S   L   F   A   T   F   L   V   V   L   V   S   L   S   L  (20)
                XmaI   1                                        10
GCA CAA ACA ACC CGG GCC TTC CCA ACC ATT CCC TTA TCC AGG CTT TTT GAC AAC GCT ATG
 A   Q   T   T   R   A   F   P   T   I   P   L   S   R   L   F   D   N   A   M  (40)
                       21                                       30
CTC CGC GCC CAT CGT CTG CAC CAG CTG GCC TTT GAC ACC TAC CAG GAG TTT GAA GAA GCC
 L   R   A   H   R   L   H   Q   L   A   F   D   T   Y   Q   E   F   E   E   A  (60)
                       41                                       50
TAT ATC CCA AAG GAA CAG AAG TAT TCA TTC CTG CAG AAC CCC CAG ACC TCC CTC TGT TTC
 Y   I   P   K   E   Q   K   Y   S   F   L   Q   N   P   Q   T   S   L   C   F  (80)
                       61                                       70
TCA GAG TCT ATT CCG ACA CCC TCC AAC AGG GAG GAA ACA CAA CAG AAA TCC AAC CTA GAG
 S   E   S   I   P   T   P   S   N   R   E   E   T   Q   Q   K   S   N   L   E  (100)
                       81                                       90
CTG CTC CGC ATC TCC CTG CTG CTC ATC CAG TCG TGG CTG GAG CCC GTG CAG TTC CTC AGG
 L   L   R   I   S   L   L   L   I   Q   S   W   L   E   P   V   Q   F   L   R  (120)
                       101                                      110
AGT GTC TTC GCC AAC AGC CTG GTG TAC GGC GCC TCT GAC AGC AAC GTC TAT GAC CTC CTA
 S   V   F   A   N   S   L   V   Y   G   A   S   D   S   N   V   Y   D   L   L  (140)
                       121                                      130
AAG GAC CTA GAG GAA GGC ATC CAA ACG CTG ATG GGG AGG CTG GAA GAT GGC AGC CCC CGG
 K   D   L   E   E   G   I   Q   T   L   M   G   R   L   E   D   G   S   P   R  (160)
                       141                                      150
ACT GGG CAG ATC TTC AAG CAG ACC TAC AGC AAG TTC GAC ACA AAC TCA CAC AAC GAT GAC
 T   G   Q   I   F   K   Q   T   Y   S   K   F   D   T   N   S   H   N   D   D  (180)
                       161                                      170
GCA CTA CTC AAG AAC TAC GGG CTG CTC TAC TGC TTC AGG AAG GAC ATG GAC AAG GTC GAG
 A   L   L   K   N   Y   G   L   L   Y   C   F   R   K   D   M   D   K   V   E  (200)
                       181                                      190       NcoI
ACA TTC CTG CGC ATC GTG CAG TGC CGC TCT GTG GAG GGC AGC TGT GGC TTC ACC ATG GCT
 T   F   L   R   I   V   Q   C   R   S   V   E   G   S   C   G   F   T   M   A  (220)
                       201                                      210
TCA CCC TCT CCA AGC CCT TCC CCA TCG CCT AGT CCC TCA CCA TCC CCT TCT CCC AGC CCA
 S   P   S   P   S   P   S   P   S   P   S   P   S   P   S   P   S   P   S   P  (240)
     Enterokinase    NcoI221             BsrGI                         SacI
GAC GAT GAT GAC AAA TCC ATG GTG-EGFP-CTG TAC AAG TAA AGCGGCCGCCACCGCGGAGGAGCTCGAATCG-3'
 D   D   D   D   K   S   M   V  EGFP  L   Y   K   *
```

FIGURE 11

Human Serum Albumin (HSA)

HSA-(SP)₁₀ construct:

Gene Sequence:

```
                                                                    BamHI
                                                                AGAGGATCCGCA
Tobacco signal sequence
ATG GGA AAA ATG GCT TCT CTA TTT GCC ACA TTT TTA GTG GTT TTA GTG TCA CTT AGC TTA
 M   G   K   M   A   S   L   F   A   T   F   L   V   V   L   V   S   L   S   L  (20)
         1                                           10
GCA CAA ACA ACC GAT GCA CAC AAG AGT GAG GTT GCT CAT CGG TTT AAA GAT TTG GGA GAA
 A   Q   T   T   D   A   H   K   S   E   V   A   H   R   F   K   D   L   G   E  (40)
        21                                           30
GAA AAT TTC AAA GCC TTG GTG TTG ATT GCC TTT GCT CAG TAT CTT CAG CAG TGT CCA TTT
 E   N   F   K   A   L   V   L   I   A   F   A   Q   Y   L   Q   Q   C   P   F  (60)
        41                                           50
GAA GAT CAT GTA AAA TTA GTG AAT GAA GTA ACT GAA TTT GCA AAA ACA TGT GTT GCT GAT
 E   D   H   V   K   L   V   N   E   V   T   E   F   A   K   T   C   V   A   D  (80)
        61                                           70
GAG TCA GCT GAA AAT TGT GAC AAA TCA CTT CAT ACC CTT TTT GGA GAC AAA TTA TGC ACA
 E   S   A   E   N   C   D   K   S   L   H   T   L   F   G   D   K   L   C   T (100)
        81                                           90
GTT GCA ACT CTT CGT GAA ACC TAT GGT GAA ATG GCT GAC TGC TGT GCA AAA CAA GAA CCT
 V   A   T   L   R   E   T   Y   G   E   M   A   D   C   C   A   K   Q   E   P (120)
       101                                          110
GAG AGA AAT GAA TGC TTC TTG CAA CAC AAA GAT GAC AAC CCA AAC CTC CCC CGA TTG GTG
 E   R   N   E   C   F   L   Q   H   K   D   D   N   P   N   L   P   R   L   V (140)
       121                                          130
AGA CCA GAG GTT GAT GTG ATG TGC ACT GCT TTT CAT GAC AAT GAA GAG ACA TTT TTG AAA
 R   P   E   V   D   V   M   C   T   A   F   H   D   N   E   E   T   F   L   K (160)
       141                                          150
AAA TAC TTA TAT GAA ATT GCC AGA AGA CAT CCT TAC TTT TAT GCC CCG GAA CTC CTT TTC
 K   Y   L   Y   E   I   A   R   R   H   P   Y   F   Y   A   P   E   L   L   F (180)
       161                                          170
TTT GCT AAA AGG TAT AAA GCT GCT TTT ACA GAA TGT TGC CAA GCT GCT GAT AAA GCT GCC
 F   A   K   R   Y   K   A   A   F   T   E   C   C   Q   A   A   D   K   A   A (200)
       181                                          190
TGC CTG TTG CCA AAG CTC GAT GAA CTT CGG GAT GAA GGG AAG GCT TCG TCT GCC AAA CAG
 C   L   L   P   K   L   D   E   L   R   D   E   G   K   A   S   S   A   K   Q (220)
       201                                          210
AGA CTC AAG TGT GCC AGT CTC CAA AAA TTT GGA GAA AGA GCT TTC AAA GCA TGG GCA GTA
 R   L   K   C   A   S   L   Q   K   F   G   E   R   A   F   K   A   W   A   V (240)
       221                                          230
GCT CGC CTG AGC CAG AGA TTT CCC AAA GCT GAG TTT GCA GAA GTT TCC AAG TTA GTG ACA
 A   R   L   S   Q   R   F   P   K   A   E   F   A   E   V   S   K   L   V   T (260)
       241                                          250
GAT CTT ACC AAA GTC CAC ACG GAA TGC TGC CAT GGA GAT CTG CTT GAA TGT GCT GAT GAC
 D   L   T   K   V   H   T   E   C   C   H   G   D   L   L   E   C   A   D   D (280)
       261                                          270
AGG GCG GAC CTT GCC AAG TAT ATC TGT GAA AAT CAA GAT TCG ATC TCC AGT AAA CTG AAG
 R   A   D   L   A   K   Y   I   C   E   N   Q   D   S   I   S   S   K   L   K (300)
       281                                          290
```

FIGURE 12A

```
     GAA TGC TGT GAA AAA CCT CTG TTG GAA AAA TCC CAC TGC ATT GCC GAA GTG GAA AAT GAT
      E   C   C   E   K   P   L   L   E   K   S   H   C   I   A   E   V   E   N   D  (320)
                    301                                         310
GAG ATG CCT GCT GAC TTG CCT TCA TTA GCT GCT GAT TTT GTT GAA AGT AAG GAT GTT TGC
 E   M   P   A   D   L   P   S   L   A   A   D   F   V   E   S   K   D   V   C  (340)
                321                                         330
AAA AAC TAT GCT GAG GCA AAG GAT GTC TTC CTG GGC ATG TTT TTG TAT GAA TAT GCA AGA
 K   N   Y   A   E   A   K   D   V   F   L   G   M   F   L   Y   E   Y   A   R  (360)
                341                                         350
AGG CAT CCT GAT TAC TCT GTC GTG CTG CTG AGA CTT GCC AAG ACA TAT GAA ACC ACT
 R   H   P   D   Y   S   V   V   L   L   R   L   A   K   T   Y   E   T   T  (380)
                361                                     370
CTA GAG AAG TGC TGT GCC GCT GCA GAT CCT CAT GAA TGC TAT GCC AAA GTG TTC GAT GAA
 L   E   K   C   C   A   A   A   D   P   H   E   C   Y   A   K   V   F   D   E  (400)
                381                                         390
TTT AAA CCT CTT GTG GAA GAG CCT CAG AAT TTA ATC AAA CAA AAT TGT GAG CTT TTT GAG
 F   K   P   L   V   E   E   P   Q   N   L   I   K   Q   N   C   E   L   F   E  (420)
                401                                         410
CAG CTT GGA GAG TAC AAA TTC CAG AAT GCG CTA TTA GTT CGT TAC ACC AAG AAA GTA CCC
 Q   L   G   E   Y   K   F   Q   N   A   L   L   V   R   Y   T   K   K   V   P  (440)
                421                                         430
CAA GTG TCA ACT CCA ACT CTT GTA GAG GTC TCA AGA AAC CTA GGA AAA GTG GGC AGC AAA
 Q   V   S   T   P   T   L   V   E   V   S   R   N   L   G   K   V   G   S   K  (460)
                441                                         450
TGT TGT AAA CAT CCT GAA GCA AAA AGA ATG CCC TGT GCA GAA GAC TAT CTA TCC GTG GTC
 C   C   K   H   P   E   A   K   R   M   P   C   A   E   D   Y   L   S   V   V  (480)
                461                                         470
CTG AAC CAG TTA TGT GTG TTG CAT GAG AAA ACG CCA GTA AGT GAC AGA GTC ACC AAA TGC
 L   N   Q   L   C   V   L   H   E   K   T   P   V   S   D   R   V   T   K   C  (500)
                481                                         490
TGC ACA GAA TCC TTG GTG AAC AGG CGA CCA TGC TTT TCA GCT CTG GAA GTC GAT GAA ACA
 C   T   E   S   L   V   N   R   R   P   C   F   S   A   L   E   V   D   E   T  (520)
                501                                         510
TAC GTT CCC AAA GAG TTT AAT GCT GAA ACG TTC ACC TTC CAT GCA GAT ATA TGC ACA CTT
 Y   V   P   K   E   F   N   A   E   T   F   T   F   H   A   D   I   C   T   L  (540)
                521                                         530
TCT GAG AAG GAG AGA CAA ATC AAG AAA CAA ACT GCA CTT GTT GAG CTT GTG AAA CAC AAG
 S   E   K   E   R   Q   I   K   K   Q   T   A   L   V   E   L   V   K   H   K  (560)
                541                                         550
CCC AAG GCA ACA AAA GAG CAA CTG AAA GCT GTT ATG GAT GAT TTC GCA GCT TTT GTA GAG
 P   K   A   T   K   E   Q   L   K   A   V   M   D   D   F   A   A   F   V   E  (580)
                561                                         570
AAG TGC TGC AAG GCT GAC GAT AAG GAG ACC TGC TTT GCC GAG GAG GGT AAA AAA CTT GTT
 K   C   C   K   A   D   D   K   E   T   C   F   A   E   E   G   K   K   L   V  (600)
                581                                         590
GCT GCA AGT CAA GCT GCC TTA GGC TTA TCA CCC TCT CCA AGC CCT TCC CCA TCG CCT AGT
 A   A   S   Q   A   A   L   G   L   S   P   S   P   S   P   S   P   S   P   S  (620)
                601             BsrGI           610                     SacI
CCC TCA CCA TCC CCT TCT CCC AGC CCA TAG CTG TAC AAG TAA AGCGGCCGCCACCGCGGAGGAGCTC
 P   S   P   S   P   S   P   *   L   Y   K   *
GAATCG-3'
```

FIGURE 12B

Human Serum Albumin Domain I-(SP)$_{10}$

Domain I-(SP)$_{10}$ construct:

Gene Sequence:

```
                                                                    BamHI
                                                               AGAGGATCCGCA
Tobacco signal sequence
ATG GGA AAA ATG GCT TCT CTA TTT GCC ACA TTT TTA GTG GTT TTA GTG TCA CTT AGC TTA
 M   G   K   M   A   S   L   F   A   T   F   L   V   V   L   V   S   L   S   L  (20)
                 1                                      10
GCA CAA ACA ACC GAT GCA CAC AAG AGT GAG GTT GCT CAT CGG TTT AAA GAT TTG GGA GAA
 A   Q   T   T   D   A   H   K   S   E   V   A   H   R   F   K   D   L   G   E  (40)
                21                                      30
GAA AAT TTC AAA GCC TTG GTG TTG ATT GCC TTT GCT CAG TAT CTT CAG CAG TGT CCA TTT
 E   N   F   K   A   L   V   L   I   A   F   A   Q   Y   L   Q   Q   C   P   F  (60)
                41                                      50
GAA GAT CAT GTA AAA TTA GTG AAT GAA GTA ACT GAA TTT GCA AAA ACA TGT GTT GCT GAT
 E   D   H   V   K   L   V   N   E   V   T   E   F   A   K   T   C   V   A   D  (80)
                61                                      70
GAG TCA GCT GAA AAT TGT GAC AAA TCA CTT CAT ACC CTT TTT GGA GAC AAA TTA TGC ACA
 E   S   A   E   N   C   D   K   S   L   H   T   L   F   G   D   K   L   C   T  (100)
                81                                      90
GTT GCA ACT CTT CGT GAA ACC TAT GGT GAA ATG GCT GAC TGC TGT GCA AAA CAA GAA CCT
 V   A   T   L   R   E   T   Y   G   E   M   A   D   C   C   A   K   Q   E   P  (120)
               101                                     110
GAG AGA AAT GAA TGC TTC TTG CAA CAC AAA GAT GAC AAC CCA AAC CTC CCC CGA TTG GTG
 E   R   N   E   C   F   L   Q   H   K   D   D   N   P   N   L   P   R   L   V  (140)
               121                                     130
AGA CCA GAG GTT GAT GTG ATG TGC ACT GCT TTT CAT GAC AAT GAA GAG ACA TTT TTG AAA
 R   P   E   V   D   V   M   C   T   A   F   H   D   N   E   E   T   F   L   K  (160)
               141                                     150
AAA TAC TTA TAT GAA ATT GCC AGA AGA CAT CCT TAC TTT TAT GCC CCG GAA CTC CTT TTC
 K   Y   L   Y   E   I   A   R   R   H   P   Y   F   Y   A   P   E   L   L   F  (180)
               161                                     170
TTT GCT AAA AGG TAT AAA GCT GCT TTT ACA GAA TGT TGC CAA GCT GCT GAT AAA GCT GCC
 F   A   K   R   Y   K   A   A   F   T   E   C   C   Q   A   A   D   K   A   A  (200)
               181                                     190
TGC CTG TTG CCA AAG CTC GAT GAA CTT CGG GAT GAA GGG AAG GCT TCG TCT GCC AAA CAG
 C   L   L   P   K   L   D   E   L   R   D   E   G   K   A   S   S   A   K   Q  (220)
               201                                     210
AGA TCA CCC TCT CCA AGC CCT TCC CCA TCG CCT AGT CCC TCA CCA TCC CCT TCT CCC AGC
 R   S   P   S   P   S   P   S   P   S   P   S   P   S   P   S   P   S   P   S  (220)
          BsrGI221                                 SacI
CCA TAG CTG TAC AAG TAA AGCGGCCGCCACCGCGGAGGAGCTCGAATCG-3'
 P   *   L   Y   K   *
```

FIGURE 13

Interferon-Alpha2a (INF2a)

INF2a-(SP)₁₀ construct:

Gene Sequence:

```
                                                                   BamHI
                                                              AGAGGATCCGCA
Tobacco signal sequence
ATG GGA AAA ATG GCT TCT CTA TTT GCC ACA TTT TTA GTG GTT TTA GTG TCA CTT AGC TTA
 M   G   K   M   A   S   L   F   A   T   F   L   V   V   L   V   S   L   S   L  (20)
                 1                                       10
GCA CAA ACA ACC TGT GAT CTG CCT CAA ACC CAC AGC CTG GGT AGC AGG AGG ACC TTG ATG
 A   Q   T   T   C   D   L   P   Q   T   H   S   L   G   S   R   R   T   L   M  (40)
                21                                       30
CTC CTG GCA CAG ATG AGG AGA ATC TCT CTT TTC TCC TGC TTG AAG GAC AGA CAT GAC TTT
 L   L   A   Q   M   R   R   I   S   L   F   S   C   L   K   D   R   H   D   F  (60)
                41                                       50
GGA TTT CCC CAG GAG GAG TTT GGC AAC CAG TTC CAA AAG GCT GAA ACC ATC CCT GTC CTC
 G   F   P   Q   E   E   F   G   N   Q   F   Q   K   A   E   T   I   P   V   L  (80)
                61                                       70
CAT GAG ATG ATC CAG CAG ATC TTC AAT CTC TTC AGC ACA AAG GAC TCA TCT GCT GCT TGG
 H   E   M   I   Q   Q   I   F   N   L   F   S   T   K   D   S   S   A   A   W  (100)
                81                                       90
GAT GAG ACC CTC CTA GAC AAA TTC TAC ACT GAA CTC TAC CAG CAG CTG AAT GAC CTG GAA
 D   E   T   L   L   D   K   F   Y   T   E   L   Y   Q   Q   L   N   D   L   E  (120)
               101                                      110
GCC TGT GTG ATA CAG GGG GTG GGG GTG ACA GAG ACT CCC CTG ATG AAG GAG GAC TCC ATT
 A   C   V   I   Q   G   V   G   V   T   E   T   P   L   M   K   E   D   S   I  (140)
               121                                      130
CTG GCT GTG AGG AAA TAC TTC CAA AGA ATC ACT CTC TAT CTG AAA GAG AAG AAA TAC AGC
 L   A   V   R   K   Y   F   Q   R   I   T   L   Y   L   K   E   K   K   Y   S  (160)
               141                                      150
CCT TGT GCC TGG GAG GTT GTC AGA GCA GAA ATC ATG AGA TCT TTT TCT TTG TCA ACA AAC
 P   C   A   W   E   V   V   R   A   E   I   M   R   S   F   S   L   S   T   N  (180)
               161                                      170
TTG CAA GAA AGT TTA AGA AGT AAG GAA TCA CCC TCT CCA AGC CCT TCC CCA TCG CCT AGT
 L   Q   E   S   L   R   S   K   E   S   P   S   P   S   P   S   P   S   P   S  (200)
               181                    BsrGI        190
CCC TCA CCA TCC CCT TCT CCC AGC CCA TGA CTG TAC AAG TAA AGCGGCCGCCACCGCGGAG
 P   S   P   S   P   S   P   S   P   *   L   Y   K   *
SacI
GAGCTCGAATCG-3'
```

FIGURE 14

Human growth hormone

1) *pUC-SS*<sup>tob</sup>*-hGH-(SP)*<sub>1</sub>

```
                                                                5'-CTGCAGGCGCTCTA
   BamHI       Tobacco signal sequence
GAGGATCCGCA ATG GGA AAA ATG GCT TCT CTA TTT GCC ACA TTT TTA GTG GTT TTA GTG TCA
            M   G   K   M   A   S   L   F   A   T   F   L   V   V   L   V   S   (20)
            1                                       10
CTT AGC TTA GCA TTC CCA ACC ATT CCC TTA TCC ACC TTT TTT CAC AAC CCT ATC CTC CCC
L   S   L   A   F   P   T   I   P   L   S   R   L   F   D   N   A   M   L   R   (40)
            21                                      30
GCC CAT CGT CTG CAC CAG CTG GCC TTT GAC ACC TAC CAG GAG TTT GAA GAA GCC TAT ATC
A   H   R   L   H   Q   L   A   F   D   T   Y   Q   E   F   E   E   A   Y   I   (60)
            41                                      50
CCA AAG GAA CAG AAG TAT TCA TTC CTG CAG AAC CCC CAG ACC TCC CTC TGT TTC TCA GAG
P   K   E   Q   K   Y   S   F   L   Q   N   P   Q   T   S   L   C   F   S   E   (80)
            61                                      70
TCT ATT CCG ACA CCC TCC AAC AGG GAG GAA ACA CAA CAG AAA TCC AAC CTA GAG CTG CTC
S   I   P   T   P   S   N   R   E   E   T   Q   Q   K   S   N   L   E   L   L   (100)
            81                                      90
CGC ATC TCC CTG CTG CTC ATC CAG TCG TGG CTG GAG CCC GTG CAG TTC CTC AGG AGT GTC
R   I   S   L   L   L   I   Q   S   W   L   E   P   V   Q   F   L   R   S   V   (120)
            101                                     110
TTC GCC AAC AGC CTG GTG TAC GGC GCC TCT GAC AGC AAC GTC TAT GAC CTC CTA AAG GAC
F   A   N   S   L   V   Y   G   A   S   D   S   N   V   Y   D   L   L   K   D   (140)
            121                                     130
CTA GAG GAA GGC ATC CAA ACG CTG ATG GGG AGG CTG GAA GAT GGC AGC CCC CGG ACT GGG
L   E   E   G   I   Q   T   L   M   G   R   L   E   D   G   S   P   R   T   G   (160)
            141                                     150
CAG ATC TTC AAG CAG ACC TAC AGC AAG TTC GAC ACA AAC TCA CAC AAC GAT GAC GCA CTA
Q   I   F   K   Q   T   Y   S   K   F   D   T   N   S   H   N   D   D   A   L   (180)
            161                                     170
CTC AAG AAC TAC GGG CTG CTC TAC TGC TTC AGG AAG GAC ATG GAC AAG GTC GAG ACA TTC
L   K   N   Y   G   L   L   Y   C   F   R   K   D   M   D   K   V   E   T   F   (200)
            181                                     190                    BsrGI
CTG CGC ATC GTG CAG TGC CGC TCT GTG GAG GGC AGC TGT GGC TTC TCA CCC TGA CTG TAC (220)
L   R   I   V   Q   C   R   S   V   E   G   S   C   G   F   S   P   *   L   Y
                                SacI
AAG TAA AGCGGCCGCCACCGCGGAGGAGCTCGAATCG-3'
K   *
```

FIGURE 19

2) pUC-SS^tob-hGH-(SP)₂

```
                                                       5'-CTGCAGGCGCTCTA
   BamHI          Tobacco signal sequence
GAGGATCCGCA ATG GGA AAA ATG GCT TCT CTA TTT GCC ACA TTT TTA GTG GTT TTA GTG TCA
            M   G   K   M   A   S   L   F   A   T   F   L   V   V   L   V   S   (20)
                1                                       10
CTT AGC TTA GCA TTC CCA ACC ATT CCC TTA TCC AGG CTT TTT GAC AAC GCT ATG CTC CGC
 L   S   L   A   F   P   T   I   P   L   S   R   L   F   D   N   A   M   L   R  (40)
                21                                      30
GCC CAT CGT CTG CAC CAG CTG GCC TTT GAC ACC TAC CAG GAG TTT GAA GAA GCC TAT ATC
 A   H   R   L   H   Q   L   A   F   D   T   Y   Q   E   F   E   E   A   Y   I  (60)
                41                                      50
CCA AAG GAA CAG AAG TAT TCA TTC CTG CAG AAC CCC CAG ACC TCC CTC TGT TTC TCA GAG
 P   K   E   Q   K   Y   S   F   L   Q   N   P   Q   T   S   L   C   F   S   E  (80)
                61                                      70
TCT ATT CCG ACA CCC TCC AAC AGG GAG GAA ACA CAA CAG AAA TCC AAC CTA GAG CTG CTC
 S   I   P   T   P   S   N   R   E   E   T   Q   Q   K   S   N   L   E   L   L  (100)
                81                                      90
CGC ATC TCC CTG CTG CTC ATC CAG TCG TGG CTG GAG CCC GTG CAG TTC CTC AGG AGT GTC
 R   I   S   L   L   L   I   Q   S   W   L   E   P   V   Q   F   L   R   S   V  (120)
                101                                     110
TTC GCC AAC AGC CTG GTG TAC GGC GCC TCT GAC AGC AAC GTC TAT GAC CTC CTA AAG GAC
 F   A   N   S   L   V   Y   G   A   S   D   S   N   V   Y   D   L   L   K   D  (140)
                121                                     130
CTA GAG GAA GGC ATC CAA ACG CTG ATG GGG AGG CTG GAA GAT GGC AGC CCC CGG ACT GGG
 L   E   E   G   I   Q   T   L   M   G   R   L   E   D   G   S   P   R   T   G  (160)
                141                                     150
CAG ATC TTC AAG CAG ACC TAC AGC AAG TTC GAC ACA AAC TCA CAC AAC GAT CAC CCA CTA
 Q   I   F   K   Q   T   Y   S   K   F   D   T   N   S   H   N   D   H   P   L  (180)
                161                                     170
CTC AAG AAC TAC GGG CTG CTC TAC TGC TTC AGG AAG GAC ATG GAC AAG GTC GAG ACA TTC
 L   K   N   Y   G   L   L   Y   C   F   R   K   D   M   D   K   V   E   T   F  (200)
                181                                     190
CTG CGC ATC GTG CAG TGC CGC TCT GTG GAG GGC AGC TGT GGC TTC TCA CCC TCT CCA TGA  (220)
 L   R   I   V   Q   C   R   S   V   E   G   S   C   G   F   S   P   S   P   *
   BsrGI                          SacI
CTG TAC AAG TAA AGCGGCCGCCACCGCGGAGGAGCTCGAATCG-3'
 L   Y   K   *
```

FIGURE 20

3) *pUC-SS^tob^-hGH-(SP)₅*

```
                                                     5'-CTGCAGGCGCTCTA
    BamHI          Tobacco signal sequence
GAGGATCCGCA ATG GGA AAA ATG GCT TCT CTA TTT GCC ACA TTT TTA GTG GTT TTA GTG TCA
            M   G   K   M   A   S   L   F   A   T   F   L   V   V   L   V   S   (20)
                            1                              10
CTT AGC TTA CCA TTC CCA ACC ATT CCC TTA TCC AGG CTT TTT CAC AAC CCT ATC CTC CCC
 L   S   L   A   F   P   T   I   P   L   S   R   L   F   D   N   A   M   L   R  (40)
            21                             30
GCC CAT CGT CTG CAC CAG CTG GCC TTT GAC ACC TAC CAG GAG TTT GAA GAA GCC TAT ATC
 A   H   R   L   H   Q   L   A   F   D   T   Y   Q   E   F   E   E   A   Y   I  (60)
            41                             50
CCA AAG GAA CAG AAG TAT TCA TTC CTG CAG AAC CCC CAG ACC TCC CTC TGT TTC TCA GAG
 P   K   E   Q   K   Y   S   F   L   Q   N   P   Q   T   S   L   C   F   S   E  (80)
            61                             70
TCT ATT CCG ACA CCC TCC AAC AGG GAG GAA ACA CAA CAG AAA TCC AAC CTA GAG CTG CTC
 S   I   P   T   P   S   N   R   E   E   T   Q   Q   K   S   N   L   E   L   L  (100)
            81                             90
CGC ATC TCC CTG CTG CTC ATC CAG TCG TGG CTG GAG CCC GTG CAG TTC CTC AGG AGT GTC
 R   I   S   L   L   L   I   Q   S   W   L   E   P   V   Q   F   L   R   S   V  (120)
            101                            110
TTC GCC AAC AGC CTG GTG TAC GGC GCC TCT GAC AGC AAC GTC TAT GAC CTC CTA AAG GAC
 F   A   N   S   L   V   Y   G   A   S   D   S   N   V   Y   D   L   L   K   D  (140)
            121                            130
CTA GAG GAA GGC ATC CAA ACG CTG ATG GGG AGG CTG GAA GAT GGC AGC CCC CGG ACT GGG
 L   E   E   G   I   Q   T   L   M   G   R   L   E   D   G   S   P   R   T   G  (160)
            141                            150
CAG ATC TTC AAG CAG ACC TAC AGC AAG TTC GAC ACA AAC TCA CAC AAC GAT GAC GCA CTA
 Q   I   F   K   Q   T   Y   S   K   F   D   T   N   S   H   N   D   D   A   L  (180)
            161                            170
CTC AAG AAC TAC GGG CTG CTC TAC TGC TTC AGG AAG GAC ATG GAC AAG GTC GAG ACA TTC
 L   K   N   Y   G   L   L   Y   C   F   R   K   D   M   D   K   V   E   T   F  (200)
            181                            190
CTG CGC ATC GTG CAG TGC CGC TCT GTG GAG GGC AGC TGT GGC TTC TCA CCC TCT CCA AGC
 L   R   I   V   Q   C   R   S   V   E   G   S   C   G   F   S   P   S   P   S  (220)
                                    BsrGI                      SacI
CCT TCC CCA TCG CCT TGA CTG TAC AAG TAA AGCGGCCGCCACCGCGGAGGAGCTCGAATCG-3'
 P   S   P   S   *   L   Y   K   *
```

FIGURE 21

4) pUC-SS^tob-hGH-(SP)_20

```
                                                           5'-CTGCAGGCGCTCTA
  BamHI           Tobacco signal sequence
GAGGATCCGCA ATG GCA AAA ATG GCT TCT CTA TTT GCC ACA TTT TTA GTG GTT TTA GTG TCA
            M   G   K   M   A   S   L   F   A   T   F   L   V   V   L   V   S   (20)
                1                                       10
CTT AGC TTA GCA TTC CCA ACC ATT CCC TTA TCC AGG CTT TTT GAC AAC GCT ATG CTC CGC
 L   S   L   A   F   P   T   I   P   L   S   R   L   F   D   N   A   M   L   R   (40)
                20                                      30
GCC CAT CGT CTG CAC CAG CTG GCC TTT GAC ACC TAC CAG GAG TTT GAA GAA GCC TAT ATC
 A   H   R   L   H   Q   L   A   F   D   T   Y   Q   E   F   E   E   A   Y   I   (60)
                40                                      50
CCA AAG GAA CAG AAG TAT TCA TTC CTG CAG AAC CCC CAG ACC TCC CTC TGT TTC TCA GAG
 P   K   E   Q   K   Y   S   F   L   Q   N   P   Q   T   S   L   C   F   S   E   (80)
                60                                      70
TCT ATT CCG ACA CCC TCC AAC AGG GAG GAA ACA CAA CAG AAA TCC AAC CTA GAG CTG CTC
 S   I   P   T   P   S   N   R   E   E   T   Q   Q   K   S   N   L   E   L   L   (100)
                80                                      90
CGC ATC TCC CTG CTG CTC ATC CAG TCG TGG CTG GAG CCC GTG CAG TTC CTC AGG AGT GTC
 R   I   S   L   L   L   I   Q   S   W   L   E   P   V   Q   F   L   R   S   V   (120)
                101                                     110
TTC GCC AAC AGC CTG GTG TAC GGC GCC TCT GAC AGC AAC GTC TAT GAC CTC CTA AAG GAC
 F   A   N   S   L   V   Y   G   A   S   D   S   N   V   Y   D   L   L   K   D   (140)
                121                                     130
CTA GAG GAA GGC ATC CAA ACG CTG ATG GGG AGG CTG GAA GAT GGC AGC CCC CGG ACT GGG
 L   E   E   G   I   Q   T   L   M   G   R   L   E   D   G   S   P   R   T   G   (160)
                141                                     150
CAG ATC TTC AAG CAG ACC TAC AGC AAG TTC GAC ACA AAC TCA CAC AAC GAT GAC GCA CTA
 Q   I   F   K   Q   T   Y   S   K   F   D   T   N   S   H   N   D   D   A   L   (180)
                161                                     170
CTC AAG AAC TAC GGG CTG CTC TAC TGC TTC AGG AAG GAC ATG GAC AAG GTC GAG ACA TTC
 L   K   N   Y   G   L   L   Y   C   F   R   K   D   M   D   K   V   E   T   F   (200)
                181                                     190
CTG CGC ATC GTG CAG TGC CGC TCT GTG GAG GGC AGC TGT GGC TTC TCA CCC TCT CCA AGC
 L   R   I   V   Q   C   R   S   V   E   G   S   C   G   F   S   P   S   P   S   (220)

CCT TCC CCA TCG CCT AGT CCC TCA CCA TCC CCT TCT CCC AGC CCA TCA CCC TCT CCA AGC
 P   S   P   S   P   S   P   S   P   S   P   S   P   S   P   S   P   S   P   S   (240)
                                                                BsrGI
CCT TCC CCA TCG CCT AGT CCC TCA CCA TCC CCT TCT CCC AGC CCA TAG CTG TAC AAG TAA
 P   S   P   S   P   S   P   S   P   S   P   S   P   S   *   L   Y   K   *   (260)
                     SacI
AGCGGCCGCCACCGCGGAGGAGCTCGAATCG-3'
```

FIGURE 22

5) *pUC-SS^tob^-(SP)₁₀-hGH-(SP)₁₀*

```
                                                        5'-CTGCAGGCGCTCTA
     BamH1              Tobacco signal sequence
GAGGATCCGCA ATG GGA AAA ATG GCT TCT CTA TTT GCC ACA TTT TTA GTC GTT TTA GTG TCA
            M   G   K   M   A   S   L   F   A   T   F   L   V   V   L   V   S   (20)
                                        10
CTT AGC TTA GCA TCA CCG TCT CCA AGC CCT TCC CCA TCG CCT AGT CCG TCA CCA TCC CCT
 L   S   L   A   S   P   S   P   S   P   S   P   S   P   S   P   S   P   S   P   (40)
                     21                                  30
TCT CCG AGC CCA TTC CCA ACC ATT CCC TTA TCC AGG CTT TTT GAC AAC GCT ATG CTC CGC
 S   P   S   P   F   P   T   I   P   L   S   R   L   F   D   N   A   M   L   R   (60)
                 41                                      50
GCC CAT CGT CTG CAC CAG CTG GCC TTT GAC ACC TAC CAG GAG TTT GAA GAA GCC TAT ATC
 A   H   R   L   H   Q   L   A   F   D   T   Y   Q   E   F   E   E   A   Y   I   (80)
                 61                                      70
CCA AAG GAA CAG AAG TAT TCA TTC CTG CAG AAC CCC CAG ACC TCC CTC TGT TTC TCA GAG
 P   K   E   Q   K   Y   S   F   L   Q   N   P   Q   T   S   L   C   F   S   E   (100)
                 81                                      90
TCT ATT CCG ACA CCC TCC AAC AGG GAG GAA ACA CAA CAG AAA TCC AAC CTA GAG CTG CTC
 S   I   P   T   P   S   N   R   E   E   T   Q   Q   K   S   N   L   E   L   L   (120)
                 101                                     110
CGC ATC TCC CTG CTG CTC ATC CAG TCG TGG CTG GAG CCC GTG CAG TTC CTC AGG AGT GTC
 R   I   S   L   L   L   I   Q   S   W   L   E   P   V   Q   F   L   R   S   V   (140)
                 121                                     130
TTC GCC AAC AGC CTG GTG TAC GGC GCC TCT GAC AGC AAC GTC TAT GAC CTC CTA AAG GAC
 F   A   N   S   L   V   Y   G   A   S   D   S   N   V   Y   D   L   L   K   D   (160)
                 141                                     150
CTA GAG GAA GGC ATC CAA ACG CTG ATG GGG AGG CTG GAA GAT GGC AGC CCC CGG ACT GGG
 L   E   E   G   I   Q   T   L   M   G   R   L   E   D   G   S   P   R   T   G   (180)
                 161                                     170
CAG ATC TTC AAG CAG ACC TAC AGC AAG TTC GAC ACA AAC TCA CAC AAC GAT GAC GCA CTA
 Q   I   F   K   Q   T   Y   S   K   F   D   T   N   S   H   N   D   D   A   L   (200)
                 181                                     190
CTC AAG AAC TAC GGG CTG CTC TAC TGC TTC AGG AAG GAC ATG GAC AAG GTC GAG ACA TTC
 L   K   N   Y   G   L   L   Y   C   F   R   K   D   M   D   K   V   E   T   F   (220)
                 201                                     210
CTG CGC ATC GTG CAG TGC CGC TCT GTG GAG GGC AGC TGT GGC TTC TCA CCC TCT CCA AGC
 L   R   I   V   Q   C   R   S   V   E   G   S   C   G   F   S   P   S   P   S   (240)
                 221                                     230          BsrGI
CCT TCC CCA TCG CCT AGT CCC TCA CCA TCC CCT TCT CCC AGC CCA TAG CTG TAC AAG TAA
 P   S   P   S   P   S   P   S   P   S   P   S   P   S   P   *   L   Y   K   *   (260)
                 SacI
ACCGGCCGCCACCGCGGAGGAGCTCGAATCG-3'
```

FIGURE 23

5) pUC-SS^tob-hGHA-(SP)_10

```
                                                                    BamH I
                                                              5'-AGAGGATCCGCA
Tobacco signal sequence
ATG GGA AAA ATG GCT TCT CTA TTT GCC ACA TTT TTA GTG GTT TTA GTG TCA CTT AGC TTA
 M   G   K   M   A   S   L   F   A   T   F   L   V   V   L   V   S   L   S   L  (20)
                                  10
GCA CAA ACA ACC TTC CCA ACC ATT CCC TTA TCC AGG CTT TTT GAC AAC GCT ATG CTC CGC
 A   Q   T   T   F   P   T   I   P   L   S   R   L   F   D   N   A   M   L   R  (40)
             21                                        30
GCC CAT CGT CTG CAC CAG CTG GCC TTT GAC ACC TAC CAG GAG TTT GAA GAA GCC TAT ATC
 A   H   R   L   H   Q   L   A   F   D   T   Y   Q   E   F   E   E   A   Y   I  (60)
                 41                                        50
CCA AAG GAA CAG AAG TAT TCA TTC CTG CAG AAC CCC CAG ACC TCC CTC TGT TTC TCA GAG
 P   K   E   Q   K   Y   S   F   L   Q   N   P   Q   T   S   L   C   F   S   E  (80)
                     61                                        70
TCT ATT CCG ACA CCC TCC AAC AGG GAG GAA ACA CAA CAG AAA TCC AAC CTA GAG CTG CTC
 S   I   P   T   P   S   N   R   E   E   T   Q   Q   K   S   N   L   E   L   L (100)
                         81                                        90
CGC ATC TCC CTG CTG CTC ATC CAG TCG TGG CTG GAG CCC GTG CAG TTC CTC AGG AGT GTC
 R   I   S   L   L   L   I   Q   S   W   L   E   P   V   Q   F   L   R   S   V (120)
                            101                                       110
TTC GCC AAC AGC CTG GTG TAC GGC GCC TCT GAC AGC AAC GTC TAT GAC CTC CTA AAG GAC
 F   A   N   S   L   V   Y   G   A   S   D   S   N   V   Y   D   L   L   K   D (140)
                                121                                       130
CTA GAG GAA AAG ATC CAA ACG CTG ATG GGG AGG CTG GAA GAT GGC AGC CCC CGG ACT GGG
 L   E   E   K   I   Q   T   L   M   G   R   L   E   D   G   S   P   R   T   G (160)
                                141                                       150
CAG ATC TTC AAG CAG ACC TAC AGC AAG TTC GAC ACA AAC TCA CAC AAC GAT GAC GCA CTA
 Q   I   F   K   Q   T   Y   S   K   F   D   T   N   S   H   N   D   D   A   L (180)
                                161                                       170
CTC AAG AAC TAC GGG CTG CTC TAC TGC TTC AGG AAG GAC ATG GAC AAG GTC GAG ACA TTC
 L   K   N   Y   G   L   L   Y   C   F   R   K   D   M   D   K   V   E   T   F (200)
                                181                                       190
CTG CGC ATC GTG CAG TGC CGC TCT GTC GAG GGC AGC TGT GGC TTC TCA CCC TCT CCA ACC
 L   R   I   V   Q   C   R   S   V   E   G   S   C   G   F   S   P   S   P   T (220)
                                201                                       210  BsrGI
CCT TCC CCA TCG CCT AGT CCC TCA CCA TCC CCT TCT CCC AGC CCA TAG CTG TAC AAG TAA
 P   S   P   S   P   S   P   S   P   S   P   S   P   S   P   S   P   *   L   Y   K   * (240)
                              SacI
AGCGGCCGCCACCGCGGAGGAGCTCGAATCG-3'
```

FIGURE 24

1) pUC-SS^tob-INF-(SP)_5

BamHI
5'-AGAGGATCCGCA

Tobacco signal sequence
```
ATG GGA AAA ATG GCT TCT CTA TTT GCC ACA TTT TTA GTG GTT TTA GTG TCA CTT AGC TTA
 M   G   K   M   A   S   L   F   A   T   F   L   V   V   L   V   S   L   S   L  (20)
                XmaI                                              10
GCA CAA ACA ACC CGG GCC TGT GAT CTG CCT CAA ACC CAC AGC CTG GGT AGC AGG AGG ACC
 A   Q   T   T   R   A   C   D   L   P   Q   T   H   S   L   G   S   R   R   T  (40)
                         21                                       30
TTG ATG CTC CTG GCA CAG ATG AGG AGA ATC TCT CTT TTC TCC TGC TTG AAG GAC AGA CAT
 L   M   L   L   A   Q   M   R   R   I   S   L   F   S   C   L   K   D   R   H  (60)
                         41                                       50
GAC TTT GGA TTT CCC CAG GAG GAG TTT GGC AAC CAG TTC CAA AAG GCT GAA ACC ATC CCT
 D   F   G   F   P   Q   E   E   F   G   N   Q   F   Q   K   A   E   T   I   P  (80)
                         61                                       70
GTC CTC CAT GAG ATG ATC CAG CAG ATC TTC AAT CTC TTC AGC ACA AAG GAC TCA TCT GCT
 V   L   H   E   M   I   Q   Q   I   F   N   L   F   S   T   K   D   S   S   A  (100)
                         81                                       90
GCT TGG GAT GAG ACC CTC CTA GAC AAA TTC TAC ACT GAA CTC TAC CAG CAG CTG AAT GAC
 A   W   D   E   T   L   L   D   K   F   Y   T   E   L   Y   Q   Q   L   N   D  (120)
                        101                                      110
CTG GAA GCC TGT GTG ATA CAG GGG GTG GGG GTG ACA GAG ACT CCC CTG ATG AAG GAG GAC
 L   E   A   C   V   I   Q   G   V   G   V   T   E   T   P   L   M   K   E   D  (140)
                        121                                      130
TCC ATT CTG GCT GTG AGG AAA TAC TTC CAA AGA ATC ACT CTC TAT CTG AAA GAG AAG AAA
 S   I   L   A   V   R   K   Y   F   Q   R   I   T   L   Y   L   K   E   K   K  (160)
                        141                                      150
TAC AGC CCT TGT GCC TGG GAG GTT GTC AGA GCA GAA ATC ATG AGA TCT TTT TCT TTG TCA
 Y   S   P   C   A   W   E   V   V   R   A   E   I   M   R   S   F   S   L   S  (180)
                        161                                      170
ACA AAC TTG CAA GAA AGT TTA AGA AGT AAG GAA TCA CCC TCT CCA AGC CCT TCC CCA TCG
 T   N   L   Q   E   S   L   R   S   K   E   S   P   S   P   S   P   S   P   S  (200)
      BsrGI             181                               SacI
CCT TGA CTG TAC AAG TAA AGC AGCGGCCGCCACCGCGGAGGAGCTCGAATCG-3'
 P   *   L   Y   K   *   S
```

FIGURE 25

*pUC-SS$^{tob}$-(SP)$_5$-INF-(SP)$_5$*

```
                                                                                    BamHI
                                                              5'-CTGCAGGCGCTCTAGAGGATCCGCA
Tobacco signal sequence
ATG GGA AAA ATG GCT TCT CTA TTT GCC ACA TTT TTA GTG GTT TTA GTG TCA CTT AGC TTA
 M   G   K   M   A   S   L   F   A   T   F   L   V   V   L   V   S   L   S   L   (20)

GCA TCA CCC TCT CCA AGC CCT TCG CCA TCG CCT TGT GAT CTG CCT CAA ACC CAC AGC CTG
 A   S   P   S   P   S   P   S   P   S   P   C   D   L   P   Q   T   H   S   L   (40)

GGT AGC AGG AGG ACC TTG ATG CTC CTG GCA CAG ATG AGG AGA ATC TCT CTT TTC TCC TGC
 G   S   R   R   T   L   M   L   L   A   Q   M   R   R   I   S   L   F   S   C   (60)

TTG AAG GAC AGA CAT GAC TTT GGA TTT CCC CAG GAG GAG TTT GGC AAC CAG TTC CAA AAG
 L   K   D   R   H   D   F   G   F   P   Q   E   E   F   G   N   Q   F   Q   K   (80)

GCT GAA ACC ATC CCT GTC CTC CAT GAG ATG ATC CAG CAG ATC TTC AAT CTC TTC AGC ACA
 A   E   T   I   P   V   L   H   E   M   I   Q   Q   I   F   N   L   F   S   T   (100)

AAG GAC TCA TCT GCT GCT TGG GAT GAG ACC CTC CTA GAC AAA TTC TAC ACT GAA CTC TAC
 K   D   S   S   A   A   W   D   E   T   L   L   D   K   F   Y   T   E   L   Y   (120)

CAG CAG CTG AAT GAC CTG GAA GCC TGT GTG ATA CAG GGG GTG GGG GTG ACA GAG ACT CCC
 Q   Q   L   N   D   L   E   A   C   V   I   Q   G   V   G   V   T   E   T   P   (140)

CTG ATG AAG GAG GAC TCC ATT CTG GCT GTG AGG AAA TAC TTC CAA AGA ATC ACT CTC TAT
 L   M   K   E   D   S   I   L   A   V   R   K   Y   F   Q   R   I   T   L   Y   (160)

CTG AAA GAG AAG AAA TAC AGC CCT TGT GCC TGG GAG GTT GTC AGA GCA GAA ATC ATG AGA
 L   K   E   K   K   Y   S   P   C   A   W   E   V   V   R   A   E   I   M   R   (180)

TCT TTT TCT TTG TCA ACA AAC TTG CAA GAA AGT TTA AGA AGT AAG GAA TCA CCC TCT CCA
 S   F   S   L   S   T   N   L   Q   E   S   L   R   S   K   E   S   P   S   P   (200)
                                 BsrGI                                   SacI
AGC CCT TCC CCA TCG CCT TGA CTG TAC AAG TAA AGC AGCGGCCGCCACCGCGGAGGAGCTCGAATCG-3'
 S   P   S   P   S   P   *   L   Y   K   *   S
```

FIGURE 26

$SS^{tob}$-$(SP)_5$-INF

```
                                                                    BamHI
                                              5'-CTGCAGGCGCTCTAGAGGATCCGCA
Tobacco signal sequence
ATG GGA AAA ATG GCT TCT CTA TTT GCC ACA TTT TTA GTG GTT TTA GTG TCA CTT AGC TTA
 M   G   K   M   A   S   L   F   A   T   F   L   V   V   L   V   S   L   S   L   (20)
                                     10
GCA TCA CCC TCT CCA AGC CCT TCC CCA TCG CCT TGT GAT CTG CCT CAA ACC CAC AGC CTG
 A   S   P   S   P   S   P   S   P   S   P   C   D   L   P   Q   T   H   S   L   (40)
                                     30
GGT AGC AGG AGG ACC TTG ATG CTC CTG GCA CAG ATG AGG AGA ATC TCT CTT TTC TCC TGC
 G   S   R   R   T   L   M   L   L   A   Q   M   R   R   I   S   L   F   S   C   (60)
                                     50
TTG AAG GAC AGA CAT GAC TTT GGA TTT CCC CAG GAG GAG TTT GGC AAC CAG TTC CAA AAG
 L   K   D   R   H   D   F   G   F   P   Q   E   E   F   G   N   Q   F   Q   K   (80)
                                     70
GCT GAA ACC ATC CCT GTC CTC CAT GAG ATG ATC CAG CAG ATC TTC AAT CTC TTC AGC ACA
 A   E   T   I   P   V   L   H   E   M   I   Q   Q   I   F   N   L   F   S   T   (100)
                                     90
AAG GAC TCA TCT GCT GCT TGG GAT GAG ACC CTC CTA GAC AAA TTC TAC ACT GAA CTC TAC
 K   D   S   S   A   A   W   D   E   T   L   L   D   K   F   Y   T   E   L   Y   (120)
                                     110
CAG CAG CTG AAT GAC CTG GAA GCC TGT GTG ATA CAG GGG GTG GGG GTG ACA GAG ACT CCC
 Q   Q   L   N   D   L   E   A   C   V   I   Q   G   V   G   V   T   E   T   P   (140)
                                     130
CTG ATG AAG GAG GAC TCC ATT CTG GCT GTG AGG AAA TAC TTC CAA AGA ATC ACT CTC TAT
 L   M   K   E   D   S   I   L   A   V   R   K   Y   F   Q   R   I   T   L   Y   (160)
                                     150
CTG AAA GAG AAG AAA TAC AGC CCT TGT GCC TGG GAG GTT GTC AGA GCA GAA ATC ATG AGA
 L   K   E   K   K   Y   S   P   C   A   W   E   V   V   R   A   E   I   M   R   (180)
                                     170                              SacI
TCT TTT TCT TTG TCA ACA AAC TTG CAA GAA AGT TTA AGA AGT AAG GAA TGA CTG TAC AAG
 S   F   S   L   S   T   N   L   Q   E   S   L   R   S   K   E   *   L   Y   K   (200)
                      BsrGI
TAA AGC AGCGGCCGCCACCGCGGAGGAGCTCGAATCG-3'
 *   S
```

FIGURE 27 pUC-SS<sup>tob</sup>-INF-(SP)<sub>20</sub>

```
                                                                    BamHI
                                                          5'-AGAGGATCCGCA
Tobacco signal sequence
ATG GGA AAA ATG GCT TCT CTA TTT GCC ACA TTT TTA GTG GTT TTA GTG TCA CTT AGC TTA
 M   G   K   M   A   S   L   F   A   T   F   L   V   V   L   V   S   L   S   L  (20)
                    XmaI               1                              10
GCA CAA ACA ACC CGG GCC TGT GAT CTG CCT CAA ACC CAC AGC CTG GGT AGC AGG AGG ACC
 A   Q   T   T   P   A   C   D   L   P   Q   T   H   S   L   G   S   R   R   T  (40)
                        21                              30
TTG ATG CTC CTG GCA CAG ATG AGG AGA ATC TCT CTT TTC TCC TGC TTG AAG GAC AGA CAT
 L   M   L   L   A   Q   M   R   R   I   S   L   F   S   C   L   K   D   R   H  (60)
                        41                              50
GAC TTT GGA TTT CCC CAG GAG GAG TTT GGC AAC CAG TTC CAA AAG GCT GAA ACC ATC CCT
 D   F   G   F   P   Q   E   E   F   G   N   Q   F   Q   K   A   E   T   I   P  (80)
                        61                              70
GTC CTC CAT GAG ATG ATC CAG CAG ATC TTC AAT CTC TTC AGC ACA AAG GAC TCA TCT GCT
 V   L   H   E   M   I   Q   Q   I   F   N   L   F   S   T   K   D   S   S   A  (100)
                        81                              90
GCT TGG GAT GAG ACC CTC CTA GAC AAA TTC TAC ACT GAA CTC TAC CAG CAG CTG AAT GAC
 A   W   D   E   T   L   L   D   K   F   Y   T   E   L   Y   Q   Q   L   N   D  (120)
                        101                             110
CTG GAA GCC TGT GTG ATA CAG GGG GTG GGG GTG ACA GAG ACT CCC CTG ATG AAG GAG GAC
 L   E   A   C   V   I   Q   G   V   G   V   T   E   T   P   L   M   K   E   D  (140)
                        121                             130
TCC ATT CTG GCT GTG AGG AAA TAC TTC CAA AGA ATC ACT CTC TAT CTG AAA GAG AAG AAA
 S   I   L   A   V   R   K   Y   F   Q   R   I   T   L   Y   L   K   E   K   K  (160)
                        141                             150
TAC AGC CCT TGT GCC TGG GAG GTT GTC AGA GCA GAA ATC ATG AGA TCT TTT TCT TTG TCA
 Y   S   P   C   A   W   E   V   V   R   A   E   I   M   R   S   F   S   L   S  (180)
                        161                             170
ACA AAC TTG CAA GAA AGT TTA AGA AGT AAG GAA TCA CCC TCT CCA AGC CCT TCC CCA TCG
 T   N   L   Q   E   S   L   R   S   K   E   S   P   S   P   S   P   S   P   S  (200)
                        181                             190
CCT AGT CCC TCA CCA TCC CCT TCT CCC AGC CCA TCC CCT TCC CCA AGC CCT TCC CCA TCG
 P   S   P   S   P   S   P   S   P   S   P   S   P   S   P   S   P   S   P   S  (260)
                        201               BsrGI         210
CCT AGT CCC TCA CCA TCC CCT TCT CCC AGC CCA TAG CTG TAC AAG TAA AGCGGCCGCCACCGC
 P   S   P   S   P   S   P   S   P   S   P   *   L   Y   K   *
       SacI
GGAGGAGCTCGAATCG-3'
```

FIGURE 28 pUC-SS^tob-(SP)₁₀-INF-(SP)₁₀

```
                                                                       BamHI
                                              5'-CTGCAGGCGCTCTAGAGGATCCGCA
Tobacco signal sequence
ATG GGA AAA ATG GCT TCT CTA TTT GCC ACA TTT TTA GTG CTT TTA GTG TCA CTT AGC TTA
 M   G   K   M   A   S   L   F   A   T   F   L   V   L   L   V   S   L   S   L  (20)
 1                                          10
GCA TCA CCC TCT CCA AGC CCT TCC CCA TCG CCT AGT CCC TCA CCA TCC CCT TCT CCC AGC
 A   S   P   S   P   S   P   S   P   S   P   S   P   S   P   S   P   S   P   S  (40)
 21                                         30
CCA TGT GAT CTG CCT CAA ACC CAC AGC CTG GGT AGC AGG AGG ACC TTG ATG CTC CTG GCA
 P   C   D   L   P   Q   T   H   S   L   G   S   R   R   T   L   M   L   L   A  (60)

CAG ATG AGG AGA ATC TCT CTT TTC TCC TGC TTG AAG GAC AGA CAT GAC TTT GGA TTT CCC
 Q   M   R   R   I   S   L   F   S   C   L   K   D   R   H   D   F   G   F   P  (80)
 41                                         50
CAG GAG GAG TTT GGC AAC CAG TTC CAA AAG GCT GAA ACC ATC CCT GTC CTC CAT GAG ATG
 Q   E   E   F   G   N   Q   F   Q   K   A   E   T   I   P   V   L   H   E   M  (100)
 61                                         70
ATC CAG CAG ATC TTC AAT CTC TTC AGC ACA AAG GAC TCA TCT GCT GCT TGG GAT GAG ACC
 I   Q   Q   I   F   N   L   F   S   T   K   D   S   S   A   A   W   D   E   T  (120)
 81                                         90
CTC CTA CAC AAA TTC TAC ACT GAA CTC TAC CAG CAG CTC AAT GAC CTG CAA GCC TGT CTC
 L   L   D   K   F   Y   T   E   L   Y   Q   Q   L   N   D   L   E   A   C   V  (140)
 101                                        110
ATA CAG GGG GTG GGG GTG ACA GAG ACT CCC CTG ATG AAG GAG GAC TCC ATT CTG GCT GTG
 I   Q   G   V   G   V   T   E   T   P   L   M   K   E   D   S   I   L   A   V  (160)
 121                                        130
AGG AAA TAC TTC CAA AGA ATC ACT CTC TAT CTG AAA GAG AAG AAA TAC AGC CCT TGT GCC
 R   K   Y   F   Q   R   I   T   L   Y   L   K   E   K   K   Y   S   P   C   A   W  (180)
 141                                        150
TGG GAG GTT GTC AGA GCA GAA ATC ATG AGA TCT TTT TCT TTG TCA ACA AAC TTG CAA GAA
 E   V   V   R   A   E   I   M   R   Y   S   F   S   L   S   T   N   L   Q   E  (200)
 161                                        170
AGT TTA AGA AGT AAG GAA TCA CCC TCT CCA AGC CCT TCC CCA TCG CCT AGT CCC TCA CCA
 S   L   R   S   K   E   S   P   S   P   S   P   S   P   S   P   S   P   S   P  (220)
 181                BsrGI              190                   SacI
TCC CCT TCT CCC AGC CCA TAG CTG TAC AAG TAA AGC AGCGGCCGCCACCGCGGAGGAGCTCAATCG-3'
 S   P   S   P   S   P   *   L   Y   K   *   S
```

FIGURE 29

GROWTH HORMONE AND INTERFERON-ALPHA 2 GLYCOPROTEINS PRODUCED IN PLANTS

This is a continuation application of U.S. Utility application Ser. No. 13/005,715, filed Jan. 13, 2011, which is a continuation of U.S. Utility application Ser. No. 12/117,692, filed May 8, 2008, which is a continuation of U.S. Utility application Ser. No. 11/036,257, filed Jan. 14, 2005, which claims priority to U.S. Provisional Application Nos. 60/536,486, filed Jan. 14, 2004, and 60/582,027, filed Jun. 22, 2004, and 60/602,562, filed Aug. 18, 2004, the entire disclosure of each of which is incorporated by reference herein.

The work leading to this invention was supported, at least in part, by NSF Grant No. MCB9874744 and USDA Project No. OHOW200206201. The U.S. government has certain rights in the invention.

DESCRIPTION OF THE INVENTION

1. Field of the Invention

The present invention relates to novel methods of producing fusion peptides, polypeptides, and proteins in plants, the nucleic acid constructs used in these methods, and the products produced according to these methods. The methods generally involve expressing the peptide, polypeptide, or protein as fusion proteins, which are glycosylated by the plant. In some embodiments, a plant-based signal peptide is expressed as part of the fusion protein. According to the present invention, novel glycoproteins are presented.

2. Background of the Invention

Support of young growing plant tissues depends largely on the turgidity of cells restrained by an elastic cell wall comprised of three interpenetrating networks, namely, cellulosic-xyloglucan, pectin, and hydroxyproline-rich glycoproteins (HRGPs). When these networks are loosened, turgor drives cell extension. Significantly, HRGPs have no animal homologs, thus emphasizing a plant-specific function.

Quantitatively, most of the cell surface HRGPs (extensins) form a covalently cross-linked cell wall network. Unlike extensins, another set of HRGPs, arabinogalactan-proteins (AGPs) occur as monomers that are hyperglycosylated by arabinogalactan polysaccharides. AGPs are initially tethered to the plasma membrane by a lipid anchor whose cleavage results in their movement from the periplasm through the cell wall to the exterior. Although implicated in diverse aspects of plant growth and development, the precise functions of AGPs remain unclear.

SUMMARY OF THE INVENTION

The present invention provides novel methods of producing glycoproteins in plants. The glycoproteins include a glycosylation site element and a core protein element. In some embodiments, the core protein element can be of mammalian (including human) origin, and in some embodiments, the core protein element can be a biologically active protein. In some cases, the protein can be an FDA-approved recombinant protein that is used therapeutically, e.g. recombinant human growth hormone ("hGH"). The glycosylation site is an amino acid sequence that acts as a target for glycosylation by the plant.

One feature of the present method is an increase in yield in protein production. By including a glycosylation site(s) and a signal peptide sequence in the expressed protein, recombinant protein yield considerably increases in comparison to expression of the same protein in plants without the glycosylation site and signal peptide sequence.

Glycoproteins produced according to the method exhibit additional advantages over their wild-type counterparts, including increased solubility, increased resistance to proteolytic enzymes, and increased stability. Another important feature includes increased biological half-life as compared to wild-type proteins.

Additional features and advantages of the invention will be set forth in part in the description that follows, and in part will be obvious from the description, or may be learned by practice of the invention. The features and advantages of the invention will be realized and attained by means of the elements and combinations particularly pointed out in the appended claims.

The present invention provides nucleic acid constructs for expression of at least one biologically active protein in plants comprising: a) at least one nucleic acid sequence encoding a glycosylation site utilized in plants and b) at least one nucleic acid sequence encoding a biologically active protein.

The invention also provides plant-derived biologically active fusion proteins comprising: a) at least one glycomodule covalently linked to b) a biologically active protein. In some embodiments, the at least one glycomodule comprises a glycosylation site chosen from i) X-Pro-Hyp$_n$ (SEQ ID NO: 1), where n is from 2 to about 1000, ii) X-Hyp$_n$ (SEQ ID NO: 2), where n is from 2 to about 1000, and iii) (X-Hyp)$_n$ (SEQ ID NO: 3), where n is from 1 to about 1000; wherein X is chosen from Lys, Ser, Ala, Thr, Gly, and Val, but is more preferably selected from Ser, Thr, Val, and Ala. In some embodiments, the at least one glycomodule is covalently linked at a location chosen from the N-terminus and/or the C-terminus of the protein. In some embodiments, the at least one glycomodule is within the interior of the biologically active mammalian protein. While Lys, Ser, Thr, Val, Gly, and Ala, are specifically identified above as corresponding to X, it is believed that any amino acid can serve that purpose, and that the motif will be glycosylated in plants.

The biologically active mammalian protein can be selected from a group including growth hormone, growth hormone antagonists, growth hormone releasing hormone, somatostatin, ghrelin, leptin, prolactin, monocyte chemoattractant protein-1, interleukin-10, pleiotropin, interleukin-7, interleukin-8, interferon omega, interferon-Alpha 2a and 2b, interferon gamma, interleukin-1, fibroblast growth factor 6, IFG-1, insulin-like growth factor I, insulin, erythropoietin, GMCSF, and any humanized monoclonal antibody or monoclonal antibody, wherein the glycomodule comprises a glycosylation site chosen from i) X-Pro-Hyp$_n$ (SEQ ID NO: 1), where n is from 2 to about 1000, ii) X-Hyp$_n$ (SEQ ID NO: 2), where n is from 2 to about 1000, and iii) (X-Hyp)$_n$ (SEQ ID NO: 3), where n is from 1 to about 1000; and wherein X is selected from Lys, Ser, Ala, Thr, Gly, and Val, and is preferably Ser, Ala, Thr, and Val. In some embodiments, the glycomodule comprises (X-Hyp)$_n$ (SEQ ID NO: 3), X is selected from Lys, Ser, Ala, Thr, Gly and Val, more preferably Ser, Ala, Thr, and Val, and n=1-1000. In some embodiments, the protein is human growth hormone, and the glycomodule comprises (Ser-Hyp)$_{10}$ (SEQ ID NO: 4). While Lys, Ser, Thr, Val, Gly, and Ala, are specifically identified as corresponding to X, it is believed that any amino acid can serve that purpose, and that the motif will be glycosylated in plants.

In some embodiments, the plant-derived biologically active mammalian fusion glycoproteins of the invention are covalently linked to at least one carbohydrate molecule. In some embodiments, the carbohydrate is an arabinogalactan moiety, and in some it is an arabinosyl moiety.

The invention also provides methods of increasing the aqueous solubility of a protein molecule, wherein one: prepares a nucleic acid construct encoding a) at least one glycosylation site and b) at least one peptide or protein; and expressing the nucleic acid construct as a glycoprotein; wherein carbohydrate component of the glycoprotein accounts for greater than or equal to about 10% of the molecular weight of the glycoprotein. The carbohydrate component of the glycoprotein can account for greater than or equal to about 50%, about 75%, or about 90% of the molecular weight of the glycoprotein.

The invention also provides methods of producing a biologically active fusion glycoprotein, comprising: expressing in a plant at least one nucleic acid construct comprising: a) at least one nucleic acid sequence encoding a glycosylation site and b) at least one nucleic acid sequence encoding a biologically active protein, as a glycoprotein; wherein the molecular weight of the glycoprotein is greater than or equal to about 10 kD and wherein the carbohydrate component of the glycoprotein accounts for greater than or equal to about 10% of the molecular weight of the glycoprotein. In some embodiments, the molecular weight of the glycoprotein is greater than or equal to about 35 kD, about 40 kD, about 45 kD, about 50 kD, or about 55 kD. In some embodiments, the pharmacokinetic half-life of the glycoprotein is greater than the pharmacokinetic half-life of a corresponding wild-type protein. In some embodiments, the at least one glycosylation site is chosen from i) X-Pro$_n$ (SEQ ID NO: 5), where n is from 2 to about 1000, and ii) (X-Pro)$_n$ (SEQ ID NO: 6), where n is from 2 to about 1000; wherein X is any amino acid or is selected from Lys, Ser, Ala, Thr, Gly and Val, or more preferably from Ser, Ala, Thr, and Val. Of course, n can range from 4 to 200 or from 6 to 100 or from 8 to 50 or from 10 to 25, or any number in between or any combination thereof. In some embodiments, the biologically active protein is human growth hormone and the glycoprotein comprises (Ser-Hyp)$_{10}$ (SEQ ID NO: 4), and in some embodiments, the (Ser-Hyp)$_{10}$ (SEQ ID NO: 4) is covalently attached to the C-terminus of the human growth hormone protein.

The invention also provides injectable pharmaceutical formulations comprising glycosylated human growth hormone, and excluding additional excipients normally required for solvating or increasing the solubility of proteins. In some embodiments, the formulation excludes at least one excipient chosen from mannitol, sorbitol, trehalose, glucose, glycine, leucine, trileucine, histidine, and phospholipid. In some embodiments, the glycosylated human growth hormone comprises a glycomodule chosen from i) X-Pro-Hyp$_n$ (SEQ ID NO: 7), where n is from 2 to about 100, and wherein X is any amino acid, or is chosen from Lys, Ser, Ala, Thr, Gly and Val, or more preferably chosen from Ser, Ala, Thr, and Val, ii) X-Hyp$_n$ (SEQ ID NO: 8), where n is from 2 to about 100, and wherein X is any amino acid, or is chosen from Lys, Ser, Ala, Thr, Gly and Val, or more preferably from Ser, Ala, Thr, and Val, and iii) (X-Hyp)$_n$ (SEQ ID NO: 9), where n is from 1 to about 100; wherein X is any amino acid or is selected from Lys, Ser, Ala, Thr, Gly and Val, or more preferably from Ser, Ala, Thr, and Val. The glycosylated growth hormone can comprise X-Hyp$_n$ (SEQ ID NO: 10), where n is from 2 to about 20; wherein X is selected from Lys, Ser, Ala, Thr, Gly and Val, or more preferably from Ser, Ala, Thr, and Val.

The invention also provides lyophilized powder formulations of glycosylated human growth hormone exhibiting a solubility of greater than or equal to about 10 mg/ml, wherein the formulation excludes additional excipients required for peptide solubility. In some embodiments, the excipient is chosen from mannitol, sorbitol, trehalose, glucose, glycine, leucine, trileucine, histidine, and phospholipid.

The invention still further provides methods of increasing the yield in plant production of a protein, comprising: preparing a nucleic acid construct comprising: a) at least one nucleic acid sequence encoding a secretory signal peptide, b) at least one nucleic acid sequence encoding a glycosylation site, and c) at least one nucleic acid sequence encoding a protein; and expressing the nucleic acid construct as a glycoprotein in plants or plant cell cultures. In some embodiments, the at least one HRGP glycosylation site is chosen from i) X-Pro$_n$ (SEQ ID NO: 5), where n is from 2 to about 1000, and ii) (X-Pro)$_n$ (SEQ ID NO: 11), where n is from 1 to about 1000; wherein X is any amino acid, or is chosen from Lys, Ser, Ala, Thr, Gly and Val, or more preferably from Ser, Ala, Thr, and Val. The nucleic acid construct can also include or exclude a nucleic acid sequence encoding green fluorescent protein. The invention also provides proteins produced according to these methods.

The invention also provides growth hormone molecules covalently attached to an amino acid sequence comprising a glycomodule, wherein the glycomodule is chosen from i) X-Pro-Hyp$_n$ (SEQ ID NO: 7), where n is from 2 to about 100, ii) X-Hyp$_n$ (SEQ ID NO: 8), where n is from 2 to about 100, and ii) (X-Hyp)$_n$ (SEQ ID NO: 9), where n is from 1 to about 100; wherein X is chosen from Lys, Ser, Ala, Thr, Gly and Val, or more preferably from Ser, Ala, Thr, and Val.

The invention also provides growth hormone antagonist molecules covalently attached to an amino acid sequence comprising a glycomodule, wherein the glycomodule is chosen from i) X-Pro-Hyp$_n$ (SEQ ID NO: 7), where n is from 2 to about 100, ii) X-Hyp$_n$ (SEQ ID NO: 8), where n is from 2 to about 100, and ii) (X-Hyp)$_n$ (SEQ ID NO: 9), where n is from 1 to about 100; wherein X is chosen from Lys, Ser, Ala, Thr, Gly and Val, or more preferably from Ser, Ala, Thr, and Val.

Also provided are methods of treating a patient suffering from growth hormone deficiency or insufficiency comprising administering a therapeutically effective amount of glycosylated human growth hormone.

Also provided are methods of treating a patient suffering from excess human growth hormone or growth hormone action comprising administering a therapeutically effective amount of glycosylated human growth hormone antagonist.

It is to be understood that both the foregoing general description and the following detailed description are exemplary and explanatory only and are not restrictive of the invention, as claimed.

The accompanying drawings, which are incorporated in and constitute a part of this specification, may illustrate embodiments of the invention, and together with the description, serve to explain the principles of the invention.

BRIEF DESCRIPTION OF THE DRAWINGS

FIG. 1 shows oligonucleotide sets used to build (a) [Gum]$_n$ (n=8, 20)m (SEQ ID NOS 12 & 13), and (b) [HP]$_m$, (m=2, 4, 8) synthetic genes by mutual priming and extension (SEQ ID NOS 14 & 15). The overlap is underlined. The restriction sites are in bold italic.

FIG. 2 shows the DNA sequence of (a) [Gum]$_3$ (SEQ ID NOS 16 & 18; encoding SEQ ID NOS 17 & 19 respectively), (b) [Gum]$_8$ and [Gum]$_{20}$ synthetic gene constructed in pUC18 plasmid between signal sequence (underlined) and GFP gene (SEQ ID NOS 20 & 22 encoding SEQ ID NOS 21 & 23, respectively when n=4; SEQ ID NOS 88 & 22 encoding SEQ ID NOS 89 & 23, respectively when n=10). The restriction sites are in bold italic.

FIG. 3 shows the DNA sequence of [HP]$_4$ and [HP]$_8$ synthetic gene constructed in pUC18 plasmid between signal sequence (underlined) and GFP gene (SEQ ID NOS 24,& 28 encoding SEQ ID NOS 25 & 29, respectively when n=4; SEQ ID NOS 26 & 28 encoding SEQ ID NOS 27 & 29, respectively when n=8). The restriction sites are in bold italic.

FIG. 4 shows the DNA sequence of [Gum]$_8$[HP]$_2$ and [Gum]$_8$[HP]$_4$ synthetic gene constructed in pUC18 plasmid between signal sequence (underlined) and GFP gene (SEQ ID NOS 30 & 34 encoding SEQ ID NOS 31 & 35, respectively when n=2; SEQ ID NOS 32 & 34 encoding SEQ ID NOS 33 & 35, respectively when n=4). The restriction sites are in bold italic.

FIG. 10A shows the gene construct for the expression of human growth hormone (hGH) (SEQ ID NO: 45 encoding SEQ ID NO: 46) with a (Ser-Hyp)$_{10}$ motif (SEQ ID NO: 4) attached. FIG. 10B shows how the (SP)$_{10}$ ((SP)$_{10}$ disclosed as SEQ ID NO: 51) gene was constructed by primer extension (SEQ ID NOS 47-49, 50 encoding 51, 47, 52-53, and 54 encoding 55, respectively in order of appearance).

FIG. 11 shows the gene construct for the expression of human growth hormone (hGH) connected to green fluorescent protein, with a (Ser-Hyp)$_{10}$ motif (SEQ ID NO: 4) connecting the two (SEQ ID NOS 56 & 58 encoding SEQ ID NOS: 57 & 59, respectively), ((SP)$_{10}$ disclosed as SEQ ID NO: 51).

FIG. 12 (A and B) shows the gene construct for the expression of human serum albumin (HSA) with a (Ser-Hyp)$_{10}$ motif (SEQ ID NO: 4) attached (SEQ ID NO: 60 encoding SEQ ID NO: 61), ((SP)$_{10}$ disclosed as SEQ ID NO: 51).

FIG. 13 shows the gene construct for the expression of human serum albumin domain I with a (Ser-Hyp)$_{10}$ motif (SEQ ID NO: 4) attached (SEQ ID NO: 62 encoding SEQ ID NO: 63), ((SP)$_{10}$ disclosed as SEQ ID NO: 51).

FIG. 14 shows the gene construct for the expression of interferon-alpha 2a (INF2a) with a (Ser-Hyp)$_{10}$ motif (SEQ ID NO: 4) attached (SEQ ID NO: 64 encoding SEQ ID NO: 65), ((SP)$_{10}$ disclosed as SEQ ID NO: 51).

FIG. 19 shows the gene sequence of SS$^{tob}$-hGH-(SP)/construct (SEQ ID NO: 66 encoding SEQ ID NO: 67). The restriction sites are in bold italic.

FIG. 20 shows the gene sequence of SS$^{tob}$-hGH-(SP)$_2$ ((SP)$_2$ disclosed as SEQ ID NO: 90) construct (SEQ ID NO: 68 encoding SEQ ID NO: 69). The restriction sites are in bold italic.

FIG. 21 shows the gene sequence of SS$^{tob}$-hGH-(SP)$_5$ ((SP)$_5$ disclosed as SEQ ID NO: 92) construct (SEQ ID NO: 70 encoding SEQ ID NO: 71). The restriction sites are in bold italic.

FIG. 22 shows the gene sequence of SS$^{tob}$-hGH-(SP)$_{20}$ ((SP)$_{20}$ disclosed as SEQ ID NO: 93) construct (SEQ ID NO: 72 encoding SEQ ID NO: 73). The restriction sites are in bold italic.

FIG. 23 shows the gene sequence of SS$^{tob}$-(SP)$_{10}$-hGH-(SP)$_{10}$ ((SP)$_{10}$ disclosed as SEQ ID NO: 51) construct (SEQ ID NO: 74 encoding SEQ ID NO: 75). The restriction sites are in bold italic.

FIG. 24 shows the gene sequence of SS$^{tob}$-hGHA-(SP)$_{10}$ ((SP)$_{10}$ disclosed as SEQ ID NO: 51) construct (SEQ ID NO: 76 encoding SEQ ID NO: 77). The restriction sites are in bold italic.

FIG. 25 shows the gene sequence of SS$^{tob}$-INF-(SP)$_5$ ((SP)$_5$ disclosed as SEQ ID NO: 92) construct (SEQ ID NO: 78 encoding SEQ ID NO: 79). The restriction sites are in bold italic.

FIG. 26 shows the gene sequence of SS$^{tob}$-(SP)$_5$-INF-(SP)$_5$ ((SP)$_5$ disclosed as SEQ ID NO: 92) construct (SEQ ID NO: 80 encoding SEQ ID NO: 81). The restriction sites are in bold italic.

FIG. 27 shows the gene sequence of SS$^{tob}$-(SP)$_5$-INF ((SP)$_5$ disclosed as SEQ ID NO: 92) construct (SEQ ID NO: 82 encoding SEQ ID NO: 83). The restriction sites are in bold italic.

FIG. 28 shows the gene sequence of SS$^{tob}$-INF-(SP)$_{20}$ ((SP)$_{20}$ disclosed as SEQ ID NO: 93) construct (SEQ ID NO: 84 encoding SEQ ID NO: 85). The restriction sites are in bold italic.

FIG. 29 shows the gene sequence of SS$^{tob}$-(SP)$_{10}$-INF-(SP)$_{10}$ ((SP)$_{10}$ disclosed as SEQ ID NO: 51) construct (SEQ ID NO: 86 encoding SEQ ID NO: 87). The restriction sites are in bold italic.

DESCRIPTION OF THE EMBODIMENTS

Figure 5:
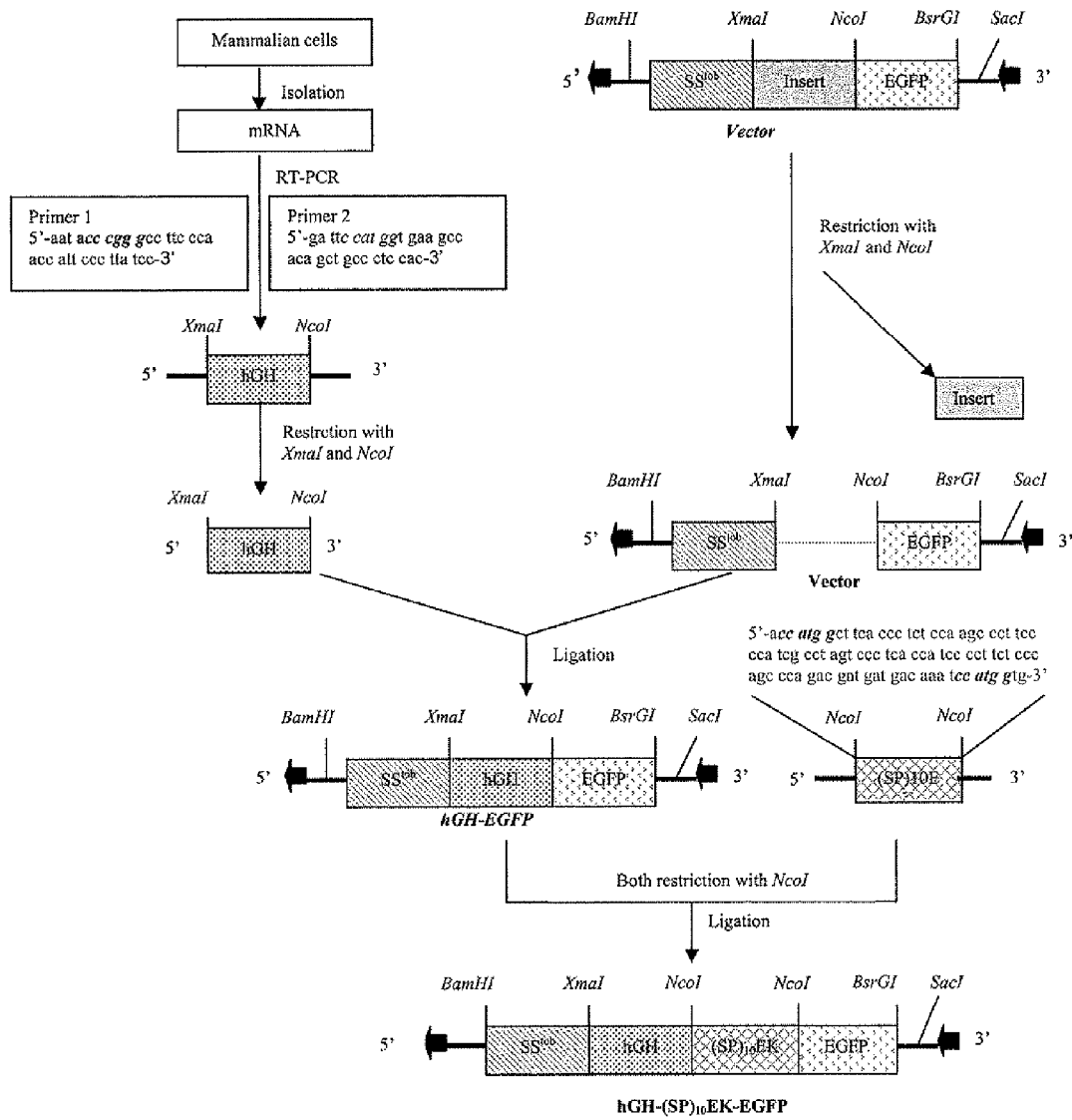
FIG. 5 shows a schematic representation of the construction of the hGH-(SP)$_{10}$-EGFP ((SP)$_{10}$ disclosed as SEQ ID NO: 51) gene cassette (primers disclosed as SEQ ID NOS 36 & 37; vector disclosed as SEQ ID NO: 38).
Figure 6:
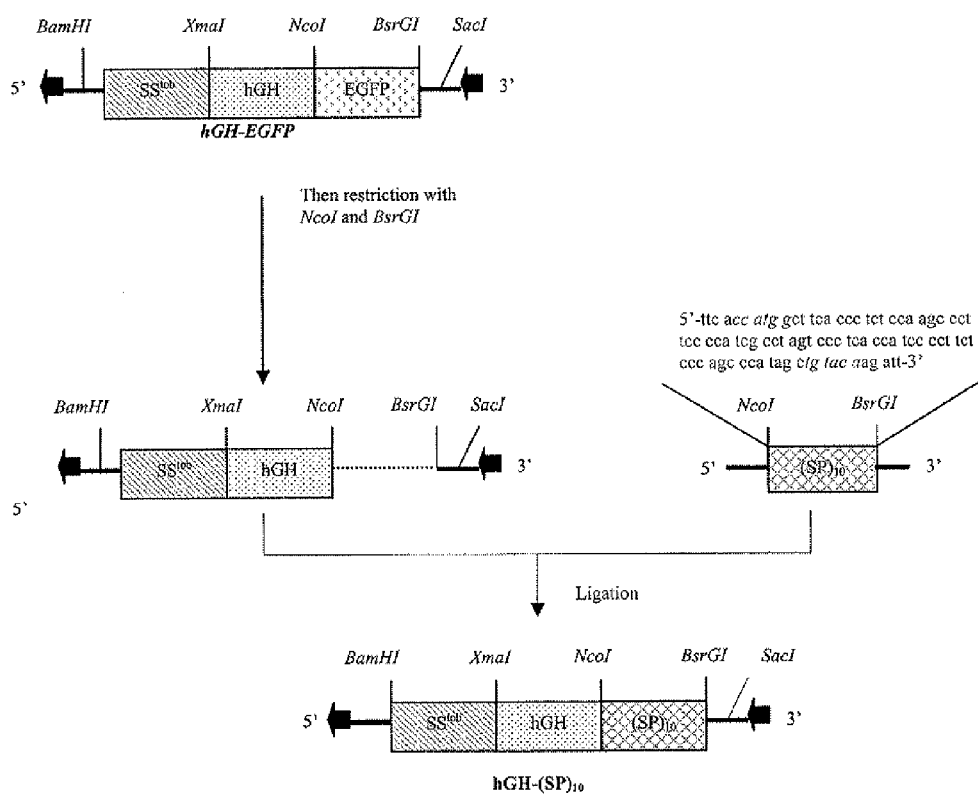
FIG. 6 shows a schematic representation of the construction of the hGH-(SP)$_{10}$ ((SP)$_{10}$ disclosed as SEQ ID NO: 51) gene cassette (nucleotide sequence disclosed as SEQ ID NO: 39).
Figure 7:
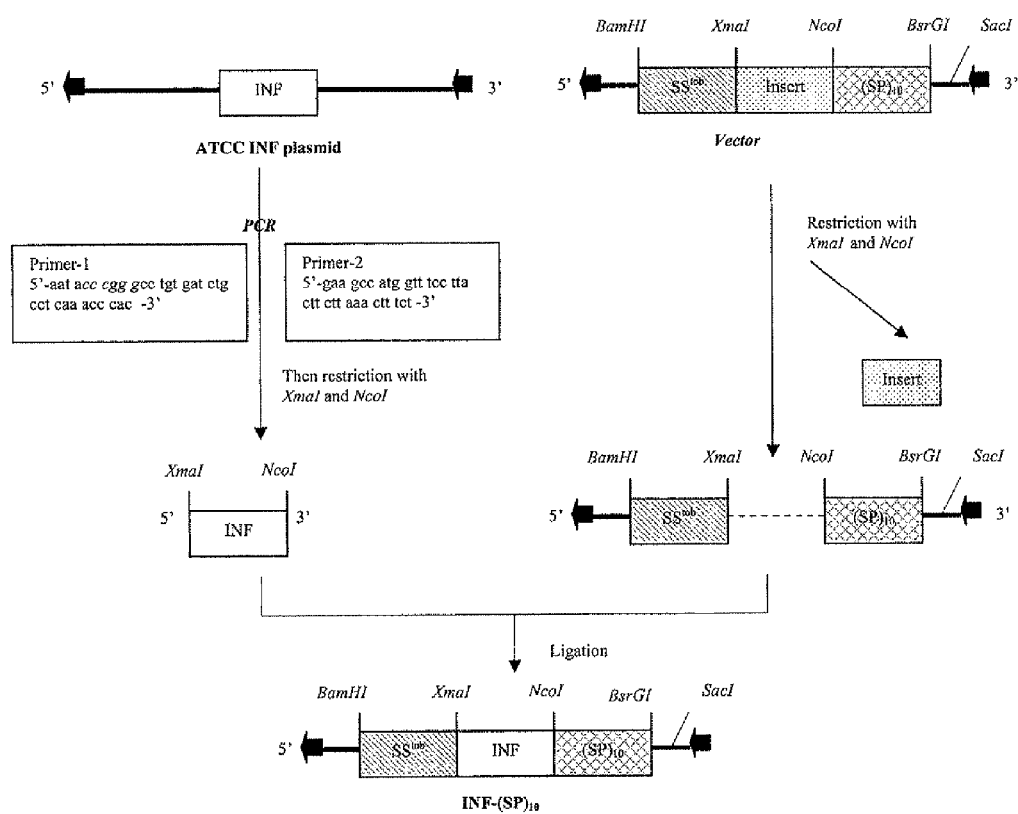
FIG. 7 shows a schematic representation of the construction of the INF-(SP)$_{10}$ ((SP)$_{10}$ disclosed as SEQ ID NO: 51) gene cassette (primers disclosed as SEQ ID NOS 40 & 41).
Figure 8:
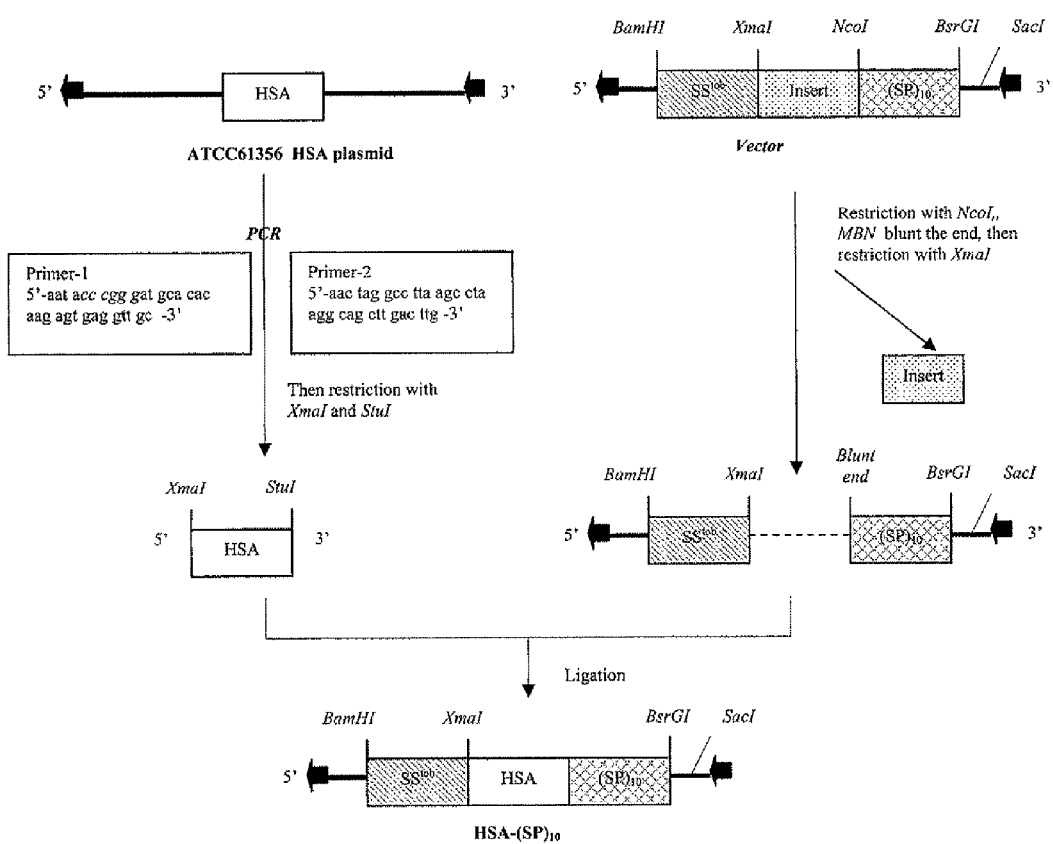
FIG. 8 shows a schematic representation of the construction of the HSA-(SP)$_{10}$ ((SP)$_{10}$ disclosed as SEQ ID NO: 51) gene cassette (primers disclosed as SEQ ID NOS 42 & 43).
Figure 9:
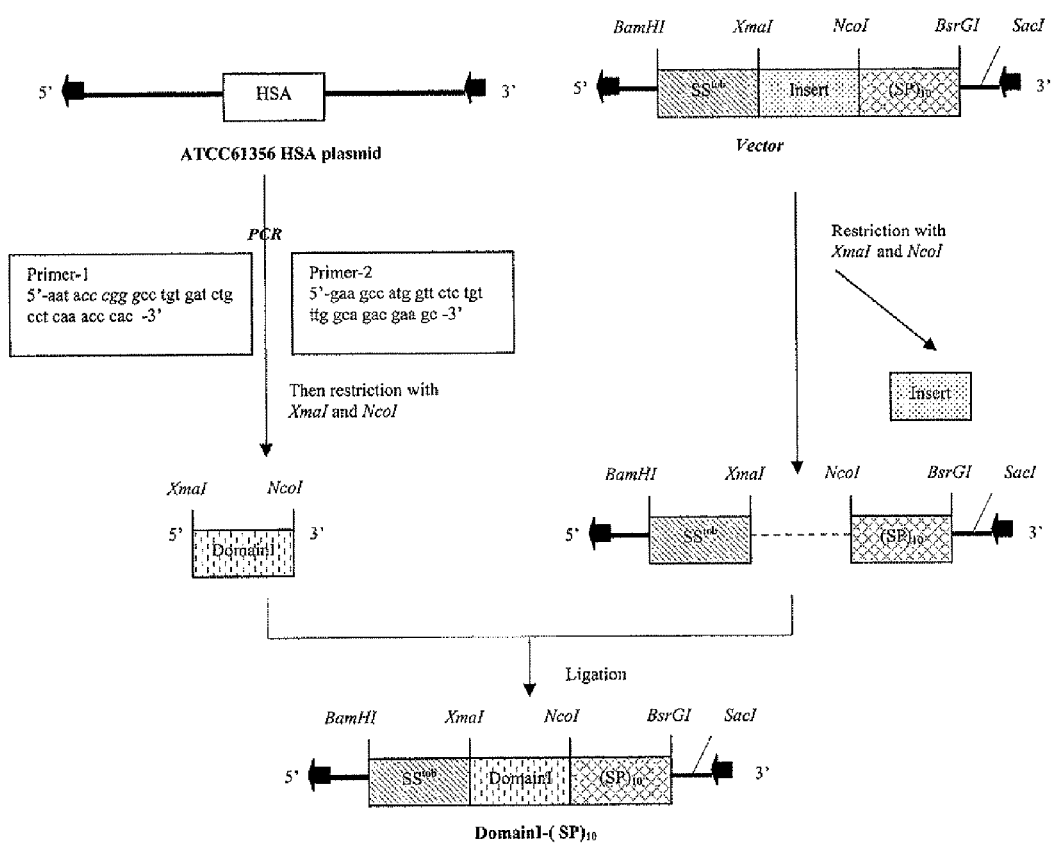
FIG. 9 shows a schematic representation of the construction of the DomainI-(SP)$_{10}$ ((SP)$_{10}$ disclosed as SEQ ID NO: 51) gene cassette (primers disclosed as SEQ ID NOS 40 & 44).

The connection between structure and function is one of the profound lessons in biology. At least two aspects of hydroxyproline-rich glycoprotein (HRGP) structural biology appear to be of functional significance: glycosylation and covalent cross-links. Because HRGPs tend to be extended repetitive modular glycoproteins, research leading to this point has focused on dissecting HRGP functional properties, module by module. Synthetic genes were designed as analogs of each putative module. This approach allowed for many discoveries: unraveling glycosylation codes, structural elucidation of glyco-substituents, identification of crosslink motifs, and the design of novel glycoproteins, including improved biomedical products.

The present work extended, and expanded upon, the Hyp-contiguity hypothesis originally proposed by Kieliszewski et al. It has now been discovered that this O-Hyp glycosylation code predicts the glycosylation sites and substituents of HRGPs. The present disclosure applies this discovery in a number of ways.

Some embodiments are directed to methods for improving the yield of protein production in plants. Some embodiments involve modified proteins produced in accordance with the present disclosure, which can exhibit improved properties overall, and specific advantages in vivo, including extended biological half-life and improved bioavailability.

The present invention will now be described by reference to more detailed embodiments, with occasional reference to the accompanying drawings. This invention may, however, be embodied in different forms and should not be construed as limited to the embodiments set forth herein. Rather, these embodiments are provided so that this disclosure will be thorough and complete, and will fully convey the scope of the invention to those skilled in the art.

Unless otherwise defined, all technical and scientific terms used herein have the same meaning as commonly understood by one of ordinary skill in the art to which this invention belongs. The terminology used in the description of the invention herein is for describing particular embodiments only and is not intended to be limiting of the invention. As used in the description of the invention and the appended claims, the singular forms "a," "an," and "the" are intended to include the plural forms as well, unless the context clearly indicates otherwise. All publications, patent applications, patents, and other references mentioned herein are expressly incorporated by reference in their entirety.

Unless otherwise indicated, all numbers expressing quantities of ingredients, reaction conditions, and so forth used in the specification and claims are to be understood as being modified in all instances by the term "about." Accordingly, unless indicated to the contrary, the numerical parameters set forth in the following specification and attached claims are approximations that may vary depending upon the desired properties sought to be obtained by the present invention. At the very least, and not as an attempt to limit the application of the doctrine of equivalents to the scope of the claims, each numerical parameter should be construed in light of the number of significant digits and ordinary rounding approaches.

Notwithstanding that the numerical ranges and parameters setting forth the broad scope of the invention are approximations, the numerical values set forth in the specific examples are reported as precisely as possible. Any numerical value, however, inherently contains certain errors necessarily resulting from the standard deviation found in their respective testing measurements. Every numerical range given throughout this specification will include every narrower numerical range that falls within such broader numerical range, as if such narrower numerical ranges were all expressly written herein.

Throughout this disclosure, reference will be made to compounds according to the invention. Reference to such compounds, in the specification and claims, includes esters and salts of such compounds. Thus, even if not explicitly recited, such esters and salts are contemplated, and encompassed, by reference to the compounds themselves.

Additionally, as used herein, "peptide," "polypeptide," and "protein," can and will be used interchangeably. "Peptide/polypeptide/protein" will occasionally be used to refer to any of the three, but recitations of any of the three contemplate the other two. That is, there is no intended limit on the size of the amino acid polymer (peptide, polypeptide, or protein), that can be expressed using the present invention. Additionally, the recitation of "protein" is intended to encompass enzymes, hormone, receptors, channels, intracellular signaling molecules, and proteins with other functions. Multimeric proteins can also be made in accordance with the present invention.

While the naturally occurring amino acids are discussed throughout this disclosure, non-naturally occurring amino acids, or modified amino acids, are also contemplated and within the scope of the invention. In fact, as used herein, "amino acid" refers to natural amino acids, non-naturally occurring amino acids, and amino acid analogs, all in their D and L stereoisomers. Natural amino acids include alanine (A), arginine (R), asparagine (N), aspartic acid (D), cysteine (C), glutamine (Q), glutamic acid (E), glycine (G), histidine (H), isoleucine (I), leucine (L), lysine (K), methionine (M), phenylalanine (F), proline (P), serine (S), threonine (T), tryptophan (W), tyrosine (Y), valine (V), hydroxyproline (O and/or Hyp), isodityrosine (IDT), and di-isodityrosine (di-IDT). Hydroxyproline, isodityrosine, and di-isodityrosine are formed post-translationally. Use of natural amino acids, in particular the 20 genetically encoded amino acids, is preferred.

Non-naturally occurring amino acids include, but are not limited to azetidinecarboxylic acid, 2-aminoadipic acid, 3-aminoadipic acid, beta-alanine, aminopropionic acid, 2-aminobutyric acid, 4-aminobutyric acid, 6-aminocaproic acid, 2-aminoheptanoic acid, 2-aminoisobutyric acid, 3-aminoisobutyric acid, 2-aminopimelic acid, 2,4 diaminoisobutyric acid, desmosine, 2,2'-diaminopimelic acid, 2,3-diaminopropionic acid, N-ethylglycine, N-ethylasparagine, hydroxylysine, allo-hydroxylysine, 3-hydroxyproline, 4-hydroxyproline, isodesmosine, allo-isoleucine, trileucine, N-methylglycine, N-methylisoleucine, N-methylvaline, norvaline, norleucine, ornithine, and pipecolic acid.

Additionally, while specific reference is made to discrete peptides, polypeptides, and/or proteins, mutants or variants of those peptides or proteins are specifically contemplated as well. A "variant" as used herein, refers to a protein (or peptide or polypeptide) whose amino acid sequence is similar to a reference peptide/polypeptide/protein, but does not have 100% identity to the respective peptide/polypeptide/protein sequence. A variant peptide/polypeptide/protein has an altered sequence in which one or more of the amino acids in the reference sequence is deleted or substituted, or one or more amino acids are inserted into the sequence of the reference amino acid sequence. A variant can have any combination of deletions, substitutions, or insertions. As a result of the alterations, a variant peptide/polypeptide/protein can have an amino acid sequence which is at least about 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or higher percent, identical to the reference sequence. Lower percent identity is also acceptable, and can range to as low as 20%.

In order to determine whether a mutant polypeptide is substantially identical with any vertebrate polypeptide, the mutant polypeptide sequence can be aligned with the sequence of a first reference vertebrate polypeptide. One method of alignment is by BlastP, using the default setting for scoring matrix and gap penalties. In one embodiment, the first reference vertebrate polypeptide is the one for which such an alignment results in the lowest E value, that is, the lowest probability that an alignment with an alignment score as good or better would occur through chance alone. Alternatively, it is the one for which such alignment results in the highest percentage identity.

Substitutions can be conservative and/or nonconservative. In conservative amino acid substitutions, the substituted amino acid has similar structural and/or chemical properties with the corresponding amino acid in the reference sequence. By way of example, conservative substitutions (replacements) are defined as exchanges within the groups set forth below:

I small aliphatic, nonpolar or slightly polar residues—Ala, Ser, Thr (Pro, Gly)

II negatively charged residues and their amides Asn Asp Glu Gln

III positively charged residues—His Arg Lys

IV large aliphatic nonpolar residues—Met Leu Ile Val (Cys)

V large aromatic residues—Phe Tyr Trp

Three residues are parenthesized because of their special roles in protein architecture. Gly is the only residue without a side chain and therefore imparts flexibility to the chain. Pro has an unusual geometry which tightly constrains the chain. Cys can participate in disulfide bonds, which hold proteins into a particular folding; the four cysteines of bGH are highly conserved. With conservative substitutions, even variants with low levels of identity can exhibit very similar activities to the unmodified peptide/polypeptide/protein.

It should be noted that "variants" in accordance with the invention include peptides/polypeptides/proteins that have greater than or fewer than the number of amino acids in the wild-type version. With respect to growth hormone, for example, the wild-type has a molecular weight of about 22 kDa, yet variants of 20 and 17 kDa also exist. These sorts of variants, which may or may not be naturally occurring, are expressly contemplated. Growth hormone antagonist, which has an approximate molecular weight of 22 kDa, also can exist in 20 and 17 kDa forms, and these forms of growth hormone antagonist are also expressly contemplated.

"Biologically active" substance refers to a substance, such as any peptide, polypeptide, or protein, which causes an observable change in the structure, function, or composition of a cell upon uptake by the cell. In some embodiments, the substance is an animal protein, in some embodiments a mammalian protein, and in some embodiments human protein. Observable changes include, but are not limited to, increased or decreased expression of one or more mRNAs, increased or decreased expression of one or more proteins, phosphorylation or dephosphorylation of a protein or other cell component, inhibition or activation of an enzyme, inhibition or activation of binding between members of a binding pair, an increased or decreased rate of synthesis of a metabolite, increased or decreased cell proliferation, and increase or decrease effect on the outward phenotype of an organism and the like. For example, administration of hGH to GH deficient children will ultimately stimulate growth. Or administration of a human GH antagonist to acromegalic individuals, will result in lower levels of IGF-1 and clinical curing of the disorder. Fragments of biologically active proteins, wherein the fragments retain biological activity, are expressly contemplated.

It should also be noted that the present methods can be used to produce fusion proteins in plants. The basic protein that is modified in the fusion protein can be of any source, plant or animal. Animal source proteins include mammalian and non-mammalian. Of course, mammalian proteins include human proteins. Frequently throughout this document, reference will be made to human forms of proteins. It should be recognized that where reference is made to human proteins, the same proteins are often also found in other non-human mammals. These other non-human mammalian proteins are expressly contemplated.

Glycosylation

The present invention generally involves expressing glycoproteins in plants using a novel approach. The approach generally involves genetically engineering nucleic acid sequences coding for glycosylation sites into genes for non-HRGP proteins/peptides/polypeptides using the codes that drive these post-translational modifications in plants. The sequences for glycosylation can be constructed as separate units attached to one or the other end of the gene, to form fusion proteins. These genes can also be engineered to code for plant signal peptide sequences to target the gene products for secretion.

Glycosylation types include, but are not limited to, arabinosylation and arabinogalactan-polysaccharide addition. Arabinosylation generally involves the addition of short (e.g., generally about 1-5) arabinooligosaccharide (generally L-arabinofuranosyl residues) chains. Arabinogalactan-polysaccharides, on the other hand, are larger and generally are formed from a core β-1,3-D-galactan backbone periodically decorated with 1,6-additions of small side chains of D-galactose and L-arabinose and occasionally with other sugars such as L-rhamnose and sugar acids such as D-glucuronic acid and its 4-o-methyl derivative. Arabinogalactan-polysaccharides can also take the form of a core β-1,6-D-galactan backbone periodically decorated with 1,6-additions of small side chains of arabinofuranosyl. Note that these adducts are added by a plant's natural enzymatic systems to proteins/peptides/ polypeptides that include the target sites for glycosylation, i.e., the glycosylation sites. There may be variation in the actual molecular structure of the glycosylation that occurs. Basically, any sugar that can be added by a plant cell, including but not limited to, The oligosaccharide chains may include any sugar which can be provided by the host cell, including, without limitation, Gal, GalNAc, Glc, GlcNAc, and Fuc, can make up the oligosaccharide chain. It should be noted that glycosylation can be achieved in vitro.

As used herein, the term "glycomodule" is meant to refer to an amino acid sequence comprising at least one proline residue that is hydroxylated and glycosylated. As used herein, the term "glycosylation site" is meant to refer an amino acid sequence comprising at least one proline residue that acts as a target site of hydroxylation and subsequent glycosylation. Glycosylation generally occurs following hydroxylation of the one or more of the proline residues in the site. Thus, within glycosylation sites, proline residues may be hydroxylated to form hydroxyprolines.

The two major types of glycosylation are achieved in accordance with the present invention by the introduction of one or more glycosylation sites into a peptide/polypeptide/ protein. Glycosylation is generally of two types: 1) arabinogalactan glycomodules comprise clustered non-contiguous hydroxyproline (Hyp) residues in which the Hyp residues are O-glycosylated with arabinogalactan adducts (the structure of which is described above); and 2) arabinosylation glycomodules comprise contiguous Hyp residues in which some or all of the Hyp residues are arabinosylated (O-glycosylated) with chains of arabinose about 1-5 residues long. See the following U.S. patents and published applications for a more detailed discussion of target sites for glycosylation, and the Hyp-contiguity theory: U.S. Pat. Nos. 6,548,642, 6,570, 062, 6,639,050 and Application Nos. 2004/0009555 and 2004/0009557. The entire disclosure of each of these patents and patent applications is incorporated herein by reference.

In particular, glycosylation sites can be introduced as follows. For arabinogalactan glycomodules (where the glycosylation sites are clustered non-contiguous Hyp residues), the genes will encode variations of $(Pro-X)_n$ (SEQ ID NO: 94) and $(X-Pro)_n$ (SEQ ID NO: 11), where n=1-1000, and $(X-Pro-X_{1-9})$, where X can be Lys, Ala, Ser, Thr, Gly or Val, or more preferably Ser, Ala, Thr, or Val. In other embodiments, n is greater than 2, 3, 5, 5, 6, 7, 8, 9, 10, 50, 100, or 500, or less than 999, 998, 997, 996, 995, 994, 993, 992, 991, 990, 900, 800, 700, 600, or 500; n can range from any number to any number between 1 and 1000. In some embodiments, n ranges from 1-100, or from 1-75, or from 1-50, or from 2-25, or from 2-10, or from 2-6. Many of the Pro residues in these sequences will be hydroxylated to hydroxyproline (Hyp) and subsequently O-glycosylated with arabinogalactan oligosaccharides or polysaccharides. It should be noted that $(X-Pro)_n$ or $(Pro-X)_n$ repeats can be interspersed with each other and with other amino acids, and that such interspersed repeating groups are expressly contemplated. While Lys, Ser, Thr, Val, Gly, and Ala, are specifically identified as corresponding to X, it is believed that any amino acid can serve that purpose, and that the motif will be glycosylated in plants. As noted, X is more preferably selected from Ser, Ala, Thr, or Val.

For arabinosylation glycomodules (where glycosylation sites are contiguous Hyp residues), genes tailored for expression will encode contiguous Pro residues $(Pro)_n$ (SEQ ID NO: 95), where n=2-1000. In other embodiments, n is greater than 3, 4, 5, 6, 7, 8, 9, 10, 50, 100, or 500, or less than 999, 998, 997, 996, 995, 994, 993, 992, 991, 990, 900, 800, 700, 600, or 500; n can range from any number to any number between 2 and 1000. In some embodiments, n ranges from 1-100, or from 1-75, or from 1-50, or from 2-25, or from 2-10, or from 2-6. Most of the Pro residues in these sequences will be hydroxylated to hydroxyproline and subsequently O-glycosylated with arabinosides ranging in size from one to five arabinose residues. It should be noted that $(Pro)_n$ repeats can be interspersed with other amino acids, and that such interspersed repeating groups are expressly contemplated.

So as to avoid confusion, it is noted that reference to nucleic acid constructs and genes reflects the fact that the nucleotides will encode proline, not hydroxyproline. Thus, nucleic acid constructs, genes, etc., will refer to Pro or P (in single letter form). Reference to genes encoding repeating units might look like: $(SP)_{10}$ (SEQ ID NO: 51), which refers to a nucleic acid construct that codes for ten repeating units of Ser-Pro. To differentiate peptides/polypeptides/proteins that have been produced in plants, reference is made to hydroxyproline, or hyp, or O (in single letter form). Thus, once the $(SP)_{10}$ (SEQ ID NO: 51) has been expressed in plants, it may be referred to as $(SO)_{10}$ (SEQ ID NO: 4).

Any combination of glycomodules within a single glycoprotein can also be made. That is, a glycoprotein can include arabinosylation glycomodules and arabinogalactan glycomodules. Thus, a single gene construct can include nucleic acid sequences coding for one or more arabinosylation sites and/or one or more arabinogalactan polysaccharide sites, which are hydroxylated and glycosylated upon expression in a plant host.

The sites for glycosylation can be placed at either or both termini of the peptide/polypeptide/protein, and/or in the interior of the molecule if desired. For example, in a smaller molecule, the N- or C-terminus might be modified by the addition of glycosylation sites; in a larger molecule, an interior substitution might be more desirable. Of course, smaller molecules can be modified on their interiors and larger molecules modified on either or both termini—the choice is left to the practitioner.

In the case of membrane-spanning or -anchored enzymes, a construct can be prepared that modifies the N-terminus by replacing the membrane-spanning or -anchoring domain (avoiding the intrinsic tendency of glycosyltransferases, for example, to associate with ER/Golgi membranes) with an N-terminal secretion signal sequence, followed by the glycosylation sequence, such as, for example, a short $(Ser-Hyp)_n$ or $(Ala-Hyp)_n$ repeat. (For example, some enzymes, such as glycosyltransferases, can be modified by replacing the N-terminal membrane-spanning sequence that often anchors the enzymes to membranes, with a signal sequence and glycomodule, allowing the glycosyltransferase to be glycosylated and secreted rather than retained in the ER or Golgi membranes.) The transgenes are designed to encode a signal sequence for secretion through the endomembrane system. The strategy of using a secretion signal sequence to target the entire molecule for secretion can be used in any construct, and is not limited to the secretion of normally membrane-tethered, -spanning, or -anchored proteins.

The addition of a glycosylation site and the subsequent glycosylation, be it by arabinosylation and/or arabinogalactan polysaccharide addition, can have a number of different effects. In some instances, the glycosylation of the peptide/ polypeptide/protein will result in an increased yield and secretion of the expressed product as compared to a non-glycosylated product that is otherwise identical. That is, adding at least one site for arabinosylation or arabinogalactan polysaccharide addition can result in an increased secreted product yield as compared to product expressed without the addition(s). The yield can be increased by about 10%, 25%, 50%, 100%, 200%, 300%, 400%, 500%, or 1000%, or more.

Glycosylation can provide additional means for isolation of a peptides/polypeptides/protein of interest. For example, by introducing a glycosylation site into a protein's gene and subsequently expressing the gene in plants, the product can be isolated and/or separated by affinity chromatography or by use of a lectin-based chromatography.

The addition of arabinooligosaccharides or arabinogalactan polysaccharides can have effects on the physicochemical activity of the peptides/polypeptides/proteins. The additions can increase the molecular weight, change the isoelectric point, and change the ability of the peptide/polypeptide/protein to modify the effects of other media. For example, glycosylation can have the effect of increasing a protein's ability to act as an emulsifier. Thus, glycoproteins made in accordance with the present invention can be used as emulsifiers. In some embodiments, glycoproteins of the invention, which act as emulsifiers, are combined with emulsifiers in pharmaceutical compositions, to improve the administration of the glycoprotein or to improve the administration of another biologically active substance.

Glycosylation can increase the molecular weight of a peptide/polypeptide/protein. The glycosylation can account for 1%, 2%, 3%, 4%, 5%, 8%, 12%, 16%, 24%, 33%, 40%, 45%, 50%, 55%, 60%, 65%, 70%, 75%, 80%, 85%, 90%, 95%, or even higher percent of the total weight of the glycoprotein. Glycosylation can add 0.1, 0.2, 0.3, 0.4, 0.5, 1, 2, 3, 4, 5, 10, 15, 20, 25, 30, 35, 40, 45, 50, 60, 70, 80, 90, or 100 kDa or more to a peptide/polypeptide/protein. Generally, glycosylation can increase the molecular weight by any percentage increment.

Glycosylation of a protein according to this invention can render insoluble proteins soluble, and can increase the solubility of already soluble proteins. Thus, in some embodiments, peptides/polypeptides/proteins modified according to these methods can be isolated or dissolved in water, where a wild-type protein may require buffer solutions. In some embodiments of the invention, the glycoproteins are more stable, in comparison to wild-type proteins, which aggregate or form multimers if not treated properly.

In particular, with regard to solubility of growth hormone and growth hormone antagonists, solubility is increased over that of the non-glycosylated versions. Increased solubility is observed in the absence of other elements required for solubility in non-glycosylated forms, such as buffers or other additives. Solubility can be greater than or equal to about 10, 15, 20, 25, 30, 40, 50, or more mg/ml.

Glycosylation of peptides/polypeptides/proteins according to the invention can have the desired effect of increasing resistance to enzymatic degradation. While it is not entirely clear why this occurs, it appears that the bulky carbohydrate substituents added in accordance with the invention block or prevent access to the sites of enzymatic degradation. Thus, where a peptidase may have specificity for a particular terminus or for a particular amino acid sequence, the glycosylation blocks, impedes, or hinders peptidase access to those sites. This protective effect has a number of real world utilities, including increasing shelf life, reducing breakdown by microbes, and of increasing the likelihood of gastrointestinal passage and thus, in some cases, allowing for oral administration.

In some embodiments, modified peptides/polypeptides/proteins of the invention that have been lyophilized can be dissolved with ease, whereas the wild-type peptides/polypeptides/proteins are more difficult to dissolve. This aspect of the invention is important in, and leads to utility in, for example, reconstituting lyophilized modified peptides/polypeptides/proteins of the invention prior to injection, which can be, for example, IM, SC, IV, or IP. Where wild-type peptides/polypeptides/proteins may be difficult to solubilize, requiring buffers, salts, or other solubilizing elements, which can cause burning or irritation on injection, some modified peptides/polypeptides/proteins of the invention can avoid those undesirable additives. Thus, in one embodiment, for example, a modified human growth hormone is made in accordance with the present invention, prepared, and packaged in the absence of mannitol; a lyophilized powder or solution for injection excludes mannitol. In one embodiment, a modified human growth hormone is made in accordance with the present invention, prepared, and packaged in the absence of added glycine; a lyophilized powder or solution for injection excludes added glycine. In one embodiment, a modified human growth hormone is made in accordance with the present invention, prepared, and packaged in the absence of added leucine; a lyophilized powder or solution for injection excludes added leucine. In one embodiment, a modified human growth hormone is made in accordance with the present invention, prepared, and packaged in the absence of added phospholipids; a lyophilized powder or solution for injection excludes added phospholipids. In one embodiment, a modified human growth hormone is made in accordance with the present invention, prepared, and packaged in the absence of added trehalose; a lyophilized powder or solution for injection excludes added trehalose. In one embodiment, a modified human growth hormone is made in accordance with the present invention, prepared, and packaged in the absence of added histidine; a lyophilized powder or solution for injection excludes added histidine. Indeed, modified growth hormone formulations of the invention, for example, can exclude any excipients normally required in other growth hormone formulations.

These impacts on physicochemical properties can be achieved without influencing biological activity. In some cases, however, glycosylation imparts additional advantages.

Because of the increased solubility and ease of dissolution, some modified peptides/polypeptides/proteins of the invention can be delivered by inhalation to the lung for a pharmacological effect. For example, a wild-type protein may be difficult to dissolve without additives. On inhalation of the wild-type protein in lyophilized powder form, dissolution in the membrane of the lung is very slow, which a) slows the rate of uptake, b) allows for phagocytosis of the particulate matter, and c) allows cilia to carry the particulate matter up and out of the lung. A modified peptide/polypeptide/protein of the invention, however, can dissolve much more quickly, thereby increasing the rate of uptake, decreasing the opportunity for phagocytosis, and preventing expulsion through ciliary action. The net effect is the creation of a drug that can be delivered by inhalation, where such delivery is not feasible for the wild-type drug.

In some embodiments of peptides/polypeptides/proteins having biological activity, the arabinosylation and/or arabinogalactan polysaccharide addition can alter the biological activity. Alteration in biological activity can be, for example, pharmacodynamic, i.e., modifying the agonist and/or antagonist activity of the peptide/polypeptide/protein. For example, a modified agonist can exhibit antagonist activity; thus, an antagonist can be made from an agonist. In other examples, modifications result in an increase or decrease in receptor affinity.

Alteration in biological activity can be, for example, pharmacokinetic, i.e., modifying the absorption, distribution, localization in tissues, biotransformation, and/or excretion of the peptide/polypeptide/protein. For example, a glycosylated peptide/polypeptide/protein can exhibit an increased bioavailability or half-life, relative to the non-glycosylated peptide/polypeptide/protein. Bioavailability or half-life can be increased by about 10%, 25%, 50%, 100%, 200%, 300%, 400%, 500%, or 1000%, or more.

Bioavailability can be generally measured by the area under the curve (AUC). The area under the curve is a plot of plasma concentration of drug (not logarithm of the concentration) against time after drug administration. The area can generally be determined by the "trapezoidal rule," wherein the data points are connected by straight line segments, perpendiculars are erected from the abscissa to each data point, and the sum of the areas of the triangles and trapezoids so constructed is computed. Area under the curve can be calculated using any means known in the art for calculating this value. In accordance with the invention, AUC can be increased by about 10%, 25%, 50%, 100%, 200%, 300%, 400%, 500%, or 1000%, or more.

An increase in bioavailability can also be reflected in an increased peak plasma concentration ($C_{max}$). In accordance with the invention, peak plasma concentration can be increased by about 10%, 25%, 50%, 100%, 200%, 300%, 400%, 500%, or 1000%, or more.

Thus, biologically active proteins produced in accordance with the present invention can have the advantage of exhibiting extended half-life and/or bioavailability, and thus exhibiting an increased or prolonged effect in the body. While it is not entirely clear how or why this occurs, it may relate to the charge and increased size imparted on the biological molecule by the carbohydrate motifs of the invention.

Another effect of the glycosylation in accordance with this invention is a lack of change in immunogenicity or antigenicity. Thus, the immunogenicity or antigenicity of a peptide/polypeptide/protein can be unchanged by producing it as a glycoprotein in accordance with this invention. In some embodiments, the immunogenicity or antigenicity is actually decreased. In either case—no change or decrease—this is important for vaccines or other parenterally introduced molecules that exhibit a desirable biological effect but are hindered by their immunogenicity/antigenicity. Specific examples include, but are not limited to, the beta-amyloid peptide.

The reduced immunogenicity (or allergenicity) relative to a base protein may result from antibodies' (in)ability to recognize the core protein. However, it should also be noted that the carbohydrate moieties can also be the epitope of an antibody, and thus, can function as an immunogen or allergen. While it's unclear what is necessary to cause antibodies to recognize those carbohydrate moieties as foreign, it is believed that glycoproteins manufactured in accordance with the present invention can serve as sensitizing agents for allergy immunotherapy. That is, glycoproteins made in accordance with the present invention can be used for repeated injections with the desired long-term effect of reducing an allergic response. In particular, arabinosylated glycoproteins (including glycopeptides or even glycosylated amino acids, such as a single hydroxyproline that has at least one arabinose attached), which include the glycomodules X-Hyp$_n$, are believed to be useful in allergy immunotherapy.

Peptides/Polypeptides/Proteins

The peptides/polypeptides/proteins that can be modified in accordance with the present invention can be from various organisms, including but not limited to, humans and other mammals and/or vertebrates, invertebrates, plants, sponges, bacteria, fungi, algae, archebacteria, etc. Additionally, synthetic proteins and peptides are expressly contemplated, as are derivatives and analogs of any protein such as antagonists, peptide agonists or antagonists, or antibodies.

The peptides/polypeptides/proteins can be large or small, monomeric or multimeric, and have any type of utility. In some embodiments, the peptides/polypeptides/proteins are small, such as less than about 25 kDa. Through glycosylation according to this invention, their molecular weight can be increased to 40 kDa or higher.

In some embodiments, the peptides/polypeptides/proteins are not post-translationally modified, except for disulfide bond formation or N-linked glycosylation. In some embodiments, peptides with many proline residues, which may be targets for hydroxylation and subsequent Hyp-glycosylation, are avoided.

Peptides/polypeptides/proteins that can be expressed using the present invention include, but are not limited to, those molecules in the growth hormone superfamily, including but not limited to, growth hormone, prolactin, placental lactogen, and other interleukins. Other specific examples include, but are not limited to, monocyte chemoattractant protein-1, interleukin-10, pleiotropin, interleukin-7, interleukin-8, interferon omega, interferon-Alpha 2a and 2b, interferon gamma, interleukin-1, fibroblast growth factor 6, IGF-1, insulin-like growth factor I and II, adrenocorticotropic hormone, beta-amyloid, amylin, atrial natriuretic polypeptide (e.g., alpha), bombesin, bradykinin, brain natriuretic peptide, calcitonin, calcitonin gene related peptide, corticotropin releasing factor, dynorphin, endorphin, endothelin (e.g., −1, −2, and −3), enkephalin, epidermal growth factor, gastric inhibitory peptide, gastrin, gastrin releasing peptide, growth hormone releasing hormone, HIV-1 envelope proteins, katacalcin, luteinizing hormone-releasing hormone, neurokinins (e.g., A and B), neuromedins (e.g., B and C), neuropeptide Y, neurotensin, oxytocin, pancreatic polypeptide, pancreatic polypeptide, pancreastin, pancreastatin, parathyroid hormone, secretin, somatostatin, substance P, transforming growth factor (e.g., alpha), vasoactive intestinal peptide, vasopressin, vasotocin, glucagon and the glucagon-like peptides, erythropoietin, granulocyte colony stimulating factor, PORF-1 and -2 (preoptic regulatory factors), and PYY 3-36. Also included are any protein growth factor, hormone, antibody, cytokine, oncoprotein (cancer causing protein), lymphokine, or derivative thereof. Also included are proteins involved in metabolic processes, including but not limited to, insulin, ghrelin, leptin, adiponectin, resistin, etc.

For example, the present invention can be used to express a modified growth hormone. Growth hormone (GH) is secreted by the pituitary gland. It is an approximately 22-kDa protein that exhibits a variety of biological activities. Hyposecretion of growth hormone results in dwarfism while hypersecretion results in gigantism and/or acromegaly. A recombinant DNA construct can be prepared that includes: the nucleic acids encoding hGH, nucleic acids coding for a hydroxyproline glycosylation site, along with nucleic acids coding for a plant signal sequence. The nucleic acids coding for a hydroxyproline glycosylation site can code for X-Pro$_n$ (SEQ ID NO: 5) (or Pro$_n$-X (SEQ ID NO: 96)), where X is Lys, Ser, Thr, Ala, Gly, Val or any amino acid, or more preferably Ser, Ala, Thr, or Val, and n is from 2 to 1000; or the nucleic acids can code for (X-Pro)$_n$ (SEQ ID NO: 11) (or (Pro-X)$_n$ (SEQ ID NO: 94)), where X is any amino acid, such as Lys, Ser, Thr, Ala, Gly, or Val, or more preferably Ser, Ala, Thr, or Val, and n is from 1 to 1000. For bulky amino acids, the first Pro in the XPPPPP (SEQ ID NO: 97) series may not be hydroxylated, but the others will be. In one embodiment, for example, the nucleic acids code for (Ser-Pro)$_{10}$ (SEQ ID NO: 51). In this embodiment, hGH is expressed as a GH-(Ser-Pro)$_{10}$ (SEQ ID NO: 51) (modified on the N- or C-terminus); the Pro is hydroxylated by the plant and then glycosylated with arabinogalactan chains. The product is an hGH glycoprotein comprising (Ser-Hyp)$_{10}$ (SEQ ID NO: 4). The glycoprotein exhibits the same activity as the wild-type hGH, yet exhibits a significantly increased pharmacokinetic half-life. (The production and testing of this embodiment is described in more detail in Example 6, herein below.)

HGH modified in accordance with the present invention can produce a peak plasma concentration of greater than about 8, 9, 10, 11, 12, 13, 14, 15, 16, 17, 18, 19, 20, 21, 22, 23, or 24 or more hours, following a single subcutaneous (SC) injection. This is a substantial increase over the half-life of wild-type growth hormone, which exhibits a half-life of about 20-30 minutes.

In one embodiment, the nucleic acids encoding hGH are engineered to create an hGH antagonist and the glycosylation site is added at the C-terminal. For example, the Gly at position 119 (found in a variety of wild-type animal's growth hormone) or Gly 120 (of hGH) can be replaced with any amino acid other that alanine and generate an antagonist. In one embodiment, Gly 120 of hGH is replaced with Lys, which produces a human growth hormone antagonist. Also, a (Ser-Hyp)$_{10}$ (SEQ ID NO: 4) motif is attached at the C-terminal. The result is a glycoprotein that exhibits hGH antagonist activity and increased half-life, as compared to the half life of unglycosylated hGH antagonist is ~20-30 minutes.

Of course, similar constructs can be created with a 20-kD variant of growth hormone, with similar results. For example, the Gly at position 104 (found in a variety of wild-type animal's 20-kDa growth hormone) or Gly 105 (of the 20-kDa human growth hormone) can be replaced with any amino acid other that alanine and generate an antagonist. In one embodiment, Gly 105 of hGH (20-kDa form) is replaced with Lys, which produces an hGH antagonist. Also, a (Ser-Hyp)$_{10}$ (SEQ ID NO: 4) motif can be attached at the C-terminal.

In one embodiment, the nucleic acids coding for hGH are engineered to insert the hydroxyproline glycosylation site in an internal part of the protein. In the case of 22-kDa GH, for example, the Gly normally at position 119 or 120 is deleted and Ser-Pro-Pro-Pro-Pro (SEQ ID NO: 98) inserted in its place. With this construct, the prolines will be hydroxylated and then arabinosylated. The result will be an antagonist with increased half-life.

The following more general description of is informative of fusion peptides/proteins of the growth hormone superfamily that can be made in accordance with this invention. In one embodiment of the present invention, the fusion protein of the present invention comprises a) at least one glycomodule, and b) a naturally occurring vertebrate hormone belonging to the GH-PRL-PL superfamily, as defined below. Vertebrate growth hormone, prolactin, or placental lactogen are of particular interest.

In another embodiment of the present invention, the fusion protein of the present invention comprises a) at least one glycomodule, and b) a biologically active mutant polypeptide which is substantially identical, but not completely identical, to a naturally occurring vertebrate growth hormone, prolactin, or placental lactogen.

The term "naturally occurring" presupposes the absence of human intervention, i.e., the fact that a transgenic mouse has been genetically engineered to produce a foreign protein does not mean that the foreign protein in question occurs naturally in mice.

This mutant may be an agonist, that is, it possesses at least one biological activity of a vertebrate growth hormone, prolactin, or placental lactogen. It should be noted that a growth hormone may be modified to become a better prolactin or placental lactogen agonist, and vice versa. The mutant may be characterized as a growth hormone mutant if, after alignments by BlastP, it has a higher percentage identity with a vertebrate growth hormone than it does with any known vertebrate prolactin or placental lactogen. Prolactin and placental lactogen mutants are analogously defined.

Alternatively, the mutant may be an antagonist of a vertebrate growth hormone, prolactin, or placental lactogen. In general, the contemplated antagonist is a receptor antagonist, that is, a molecule that binds to the receptor but which substantially fails to activate it, thereby antagonizing receptor activity via the mechanism of competitive inhibition. The first identification of GH mutants that encoded biologically active GH receptor antagonists was in Kopchick et al., U.S. Pat. Nos. 5,350,836, 5,681,809, 5,958,879, 6,583,115, and 6,787,336, and in Chen et al., 1991, "Functional antagonism between endogenous mouse growth hormone (GH) and a GH analog results in dwarf transgenic mice", Endocrinology 129:1402-1408, Chen et al., 1991, "Glycine 119 of bovine growth hormone is critical for growth promoting activity" Mol. Endocrinology. 5:1845-1852, and Chen et al., 1991, "Mutations in the third .alpha.-helix of bovine growth hormone dramatically affect its intracellular distribution in vitro and growth enhancement in transgenic mice", J. Biol. Chem. 266:2252-2258. All of these references (hereinafter, "Kopchick, et al., supra") are hereby incorporated by reference in their entirety.

In order to determine whether the mutant polypeptide is substantially identical with any vertebrate hormone of the GH-PRL_PL superfamily, the mutant polypeptide sequence can be aligned with the sequence of a first reference vertebrate hormone of that superfamily. One method of alignment is by BlastP, using the default setting for scoring matrix and gap penalties. In one embodiment, the first reference vertebrate hormone is the one for which such an alignment results in the lowest E value, that is, the lowest probability that an alignment with an alignment score as good or better would occur through chance alone. Alternatively, it is the one for which such alignment results in the highest percentage identity.

In general, the mutant polypeptide agonist is considered substantially identical to the reference vertebrate hormone if all of the differences can be justified as being (1) conservative substitutions of amino acids known to be preferentially exchanged in families of homologous proteins, (2) non-conservative substitutions of amino acid positions known or determinable (e.g., by virtue of alanine scanning mutagenesis) to be unlikely to result in the loss of the relevant biological activity, or (3) variations (substitutions, insertions, deletions) observed within the GH-PRL-PL superfamily (or, more particularly, within the relevant family). The mutant polypeptide antagonist will additionally differ from the reference vertebrate hormone by virtue of one or more receptor antagonizing mutations.

With regard to applying point (3) above to insertions and deletions, it is necessary to align the mutant polypeptide with at least two different reference hormones. This is done by pairwise alignment of each reference hormone to the mutant polypeptide.

When two sequences are aligned to each other, the alignment algorithm(s) may introduce gaps into one or both sequences. If there is a length one gap in sequence A corresponding to position X in sequence B, then we can say, equivalently, that (1) sequence A differs from sequence B by virtue of the deletion of the amino acid at position X in sequence B, or (2) sequence B differs from sequence A by virtue of the insertion of the amino acid at position X of sequence B, between the amino acids of sequence A which were aligned with positions X−1 and X+1 of sequence B.

If alignment of the mutant sequence to the first reference hormone creates a gap in the mutant sequence, then the mutant sequence can be characterized as differing from the first reference hormone by deletion of the amino acid at that position in the first reference hormone, and such deletion is justified under clause (3) if another reference hormone differs from the first reference hormone in the same way.

Likewise, if the alignment of the mutant sequence to the first reference hormone creates a gap in the reference sequence, then the mutant sequence can be characterized as differing from the first reference hormone by insertion of the amino acid aligned with that gap, and such insertion is justified under clause (3) if another reference hormone differs from the first reference hormone in the same way.

The preferred vertebrate GH-derived GH receptor agonists of the present invention are fusion proteins which comprise a polypeptide sequence P for which the differences, if any, between said amino acid sequence and the amino acid sequence of a first reference vertebrate growth hormone, are independently selected from the group consisting of (a) a substitution of a conservative replacement amino acid for the corresponding first reference vertebrate growth hormone residue;

(b) a substitution of a non-conservative replacement amino acid for the corresponding first reference vertebrate growth hormone residue where
  (i) another reference vertebrate growth hormone exists for which the corresponding amino acid is a non-conservative substitution for the corresponding first reference vertebrate growth hormone residue, and/or
  (ii) the binding affinity of a single substitution mutant of the first reference vertebrate growth hormone, wherein said corresponding residue, which is not alanine, is replaced by alanine, is at least 10% of the binding affinity of the first vertebrate growth hormone for the vertebrate growth hormone receptor to which the first vertebrate growth hormone natively binds;

(c) a deletion of one or more residues found in said first reference vertebrate growth hormone but deleted in another reference vertebrate growth hormone;

(d) insertion of one or more residues into said first reference vertebrate growth hormone between adjacent amino acid positions of said first reference vertebrate growth hormone, where another reference vertebrate growth hormone exists which differs from said first reference growth hormone by virtue of an insertion at the same location of said first reference vertebrate growth hormone; and (e) truncation of the first 1-8, 1-6, 1-4, or 1-3 residues and/or the last 1-8, 1-6, 1-4, or 1-3 residues found in said first reference vertebrate growth hormone ("truncation" is intended to refer to a deletion of residues at the N- or C-terminal of the peptide);

where the polypeptide sequence has at least 10% of the binding affinity of said first reference vertebrate growth hormone for a vertebrate growth hormone receptor, preferably one to which said first reference vertebrate growth hormone natively binds, and where said fusion protein binds to and thereby activates a vertebrate growth hormone receptor.

We characterize the fusion protein as "GH-derived" because the polypeptide sequence P qualifies as a vertebrate GH or as a vertebrate GH mutant as defined above.

A growth hormone natively binds a growth hormone receptor found in the same species, i.e., human growth hormone natively binds a human growth hormone receptor, bovine growth hormone, a bovine GH receptor, and so forth.

Based on analyses of the frequencies of amino acid changes between homologous proteins of different organisms, such as those presented in Table 1-2 of Schulz and Schirmer, *Principles of Protein Structure* and FIG. 3-9 of Creighton, *Proteins*, we define conservative substitutions (replacements) as exchanges within the groups set forth below:

I small aliphatic, nonpolar or slightly polar residues—Ala, Ser, Thr (Pro, Gly)
  II negatively charged residues and their amides Asn Asp Glu Gln
  III positively charged residues—His Arg Lys
  IV large aliphatic nonpolar residues—Met Leu Ile Val (Cys)
  V large aromatic residues—Phe Tyr Trp Three residues are parenthesized because of their special roles in protein architecture. Gly is the only residue without a side chain and therefore imparts flexibility to the chain. Pro has an unusual geometry which tightly constrains the chain. Cys can participate in disulfide bonds, which hold proteins into a particular folding; the four cysteines of bGH are highly conserved.

Mutations which exchange I/II, or which exchange III/IV/V, may be considered semi-conservative, which are a subset of nonconservative mutations. Nonconservative mutations, which are not characterized as semi-conservative may be characterized as "strongly non-conservative." Semi-conservative mutations are preferred over strongly non-conservative mutations.

For binding to the human growth hormone receptor, binding affinity is determined by the method described in Cunningham and Wells, "High-Resolution Mapping of hGH-Receptor Interactions by Alanine Scanning Mutagenesis", Science 284: 1081 (1989), and thus uses the hGHRbp as the target. For binding to the human prolactin receptor, binding is determined by the method described in WO92/03478, and thus uses the hPRLbp as the target. For binding to nonhuman vertebrate hormone receptors, binding affinity is determined by use, in order of preference, of the extracellular binding domain of the receptor, the purified whole receptor, and an unpurified source of the receptor (e.g., a membrane preparation).

The receptor binding fusion protein preferably has growth promoting activity in a vertebrate. Growth promoting (or inhibitory) activity may be determined by the assays set forth in Kopchick, et al., which involve transgenic expression of the GH agonist or antagonist in mice. Or it may be determined by examining the effect of pharmaceutical administration of the GH agonist or antagonist to humans or nonhuman vertebrates.

Preferably, one or more of the following further conditions apply:

(1) the polypeptide sequence P is at least 50%, more preferably at least 55%, at least 60%, at least 65%, at least 70%, at least 75%, at least 80%, at least 85%, at least 90% or most preferably at least 95% identical to said first reference vertebrate growth hormone, (2) the conservative replacement amino acids are highly conservative replacement amino acids, (3) any deletion under clause (c) is of a residue which is not located at a conserved residue position of the vertebrate growth hormone family, and, more preferably is not a conserved residue position of the mammalian growth hormone subfamily, (4) the first reference vertebrate growth hormone is a mammalian growth hormone, more preferably, a human or bovine growth hormone, (5) any insertion under clause (d) is of a length such that another reference vertebrate growth hormone exists which differs from said first reference growth hormone by virtue of an equal length insertion at the same location of said first reference vertebrate growth hormone (6) the differences are limited are limited to substitutions pursuant to clauses (a) and/or (b), (7) if the first reference vertebrate growth hormone is a nonhuman growth hormone, and the intended use is in binding or activating the human growth hormone receptor, the differences increase the overall identity to human growth hormone, (8) one or more of the substitutions are selected from the group consisting of one or more of the mutations characterizing the hGH mutants B2024 and/or B2036 as described below, (9) the polypeptide sequence P is at least 50%, more preferably at least 55%, at least 60%, at least 65%, at least 70% at least 75%, at least 80%, at least 85%, at least 90%, at least 95% or, if an agonist, most preferably 100% similar to said first reference vertebrate growth hormone, or

(10) the polypeptide sequence P, when aligned to the first reference vertebrate growth hormone by BlastP using the Blosum62 matrix and the gap penalties −11 for gap creation and −1 for each gap extension, results in an alignment for which the E value is less than e-10, more preferably less than e-20, e-30, e-40, e-50, e-60, e-70, e-80, e-90 or most preferably e-100.

For purposes of condition (1), percentage identity is calculated by the BlastP methodology, i.e., identities as a percentage of the aligned overlap region including internal gaps. For purposes of condition (2), highly conservative amino acid replacements are as follows: Asp/Glu, Arg/His/Lys, Met/Leu/Ile/Val, and Phe/Tyr/Trp. For purposes of condition (3), the conserved residue positions are those which, when all vertebrate growth hormones whose sequences are in a publicly available sequence database as of the time of filing are aligned as taught herein, are occupied only by amino acids belonging to the same conservative substitution exchange group (I, II, III, IV or V) as defined above. The unconserved residue positions are those which are occupied by amino acids belonging to different exchange groups, and/or which are unoccupied (i.e., deleted) in one or more of the vertebrate growth hormones. The fully conserved residue positions of the vertebrate growth hormone family are those residue positions are occupied by the same amino acid in all of said vertebrate growth hormones. Clause (c) does not permit deletion of a residue at one of the fully conserved residue positions. One may analogously define fully conserved, conserved, and unconserved residue positions of the mammalian growth hormone family.

For purposes of condition (4), hGH is preferably the form of hGH which corresponds to the mature portion (AAs 27-217) of the sequence set forth in Swiss-Prot SOMA_HUMAN, P01241, isoform 1 (22 kDa), and bovine growth hormone is preferably the form of bovine growth hormone which corresponds to the mature portion (AA 28-217) of the sequence set forth in Swiss-Prot SOMA_BOVIN, P01246, per Miller W. L., Martial J. A., Baxter J. D.; "Molecular cloning of DNA complementary to bovine growth hormone mRNA."; J. Biol. Chem. 255:7521-7524 (1980). These references are incorporated by reference in their entirety. For purpose of condition (10), percentage similarity is calculated by the BlastP methodology, i.e., positives (aligned pairs with a positive score in the Blosum62 matrix) as a percentage of the aligned overlap region including internal gaps.

Vertebrate GH-derived GH receptor antagonists of the present invention may be similarly defined, except that the polypeptide sequence must additionally differ from the sequence of the reference vertebrate growth hormone, e.g., at the position corresponding to Gly 119 in bovine growth hormone or Gly 120 in human growth hormone, in such manner as to impart GH receptor antagonist (binds but does not activate) activity to the polypeptide sequence and thereby to the fusion protein. Note that bGH Gly119/hGH Gly 120 is presently believed to be a fully conserved residue position in the vertebrate GH family. It has been reported that an independent mutation, R77C, can result in growth inhibition. See Takahashi Y, Kaji H, Okimura Y, Goji K, Abe H, Chihara K., "Brief report: short stature caused by a mutant growth hormone.", N Engl J Med. 1996 Feb. 15; 334(7):432-6.

Preferably, the GH receptor antagonist has growth inhibitory activity. The compound is considered to be growth-inhibitory if the growth of test animals of at least one vertebrate species which are treated with the compound (or which have been genetically engineered to express it themselves) is significantly (at a 0.95 confidence level) slower than the growth of control animals (the term "significant" being used in its statistical sense). In some embodiments, it is growth-inhibitory in a plurality of species, or at least in humans and/or bovines.

Also, the GH antagonists may comprise an alpha helix essentially corresponding to the third major alpha helix of the first reference vertebrate growth hormone, and at least 50% identical (more preferably at least 80% identical) therewith. However, the mutations need not be limited to the third major alpha helix.

The contemplated vertebrate GH antagonists include, in particular, fusions in which the polypeptide P corresponds to the hGH mutants B2024 and B2036 as defined in U.S. Pat. No. 5,849,535. Note that B2024 and B2036 are both hGH mutants including, inter alia, a G10K substitution. In addition, we contemplate GH antagonists in which B2024 and B2036 are further mutated in accordance, mutatis mutandis, with the principles set forth above, i.e., in which B2024 or B2036 serves in place of a naturally occurring GH such as HGH as the reference vertebrate GH.

In a like manner, one may define vertebrate prolactin agonists and antagonists, and vertebrate placental lactogen agonists and antagonists, which agonize or antagonize a vertebrate prolactin receptor. One may also have mutants of a vertebrate growth hormone, which agonize or antagonize the prolactin receptor (with or without retention of activity against a growth hormone receptor), and mutants of a vertebrate prolactin or placental lactogen, which agonize or antagonize a vertebrate growth hormone receptor (with or without retention of activity against a prolactin receptor). In a like manner, one may define agonists and antagonists that are hybrids, or are mutants of hybrids, of two or more reference hormones of the vertebrate growth hormone—prolactin—placental lactogen hormone superfamily, and which retain at least 10% of at least one receptor binding activity of at least one of the reference hormones.

There are several ways in which these hybrids can be defined. In one embodiment, we simply permit the first reference vertebrate growth hormone and the another reference vertebrate growth hormone to be any vertebrate hormone which is a member of the superfamily. In a second embodiment, the mutant is mostly defined on the basis of one family, e.g., GH, but at a limited number of positions, e.g., less than 10% or less than 5% of the sequence P, it is permitted to choose from another family. In this category is the Cunningham prolactin octomutant, infra, which binds hGH. In a third embodiment, the hybrid is a segmented hybrid, such as a dihybrid visualized as consisting of segments which are alternately derived from (a) the vertebrate growth hormone family or (b) the vertebrate prolactin family, starting with either. The number of segments may be odd or even, e.g., 2, 3, 4, 5, 6, 7, 8, 9 or 10. Preferably, there are not more than ten segments. In a GH-derived segment, the reference hormones are vertebrate GHs, and in prolactin-derived segments, the reference hormones are vertebrate prolactins. Preferably, each segment is at least ten consecutive amino acids long. The segments may be unequal in length. Cunningham, infra, describes several GH/prolactin hybrids (or mutants thereof) which have three segments, of the format (GH-derived)-(prolactin-derived)-(GH derived). In a like manner, the segmented hybrid may be a GH/PL or PL/PRL dihybrid, or a GH/PRL/PL trihybrid (in the last case, the rule is that adjacent segments are derived from different families, whether GH, PRL or PL).

Growth Hormone-Prolactin-Placental Lactogen Family

Growth hormones, placental lactogens, and prolactins are homologous proteins, thought to have arisen from a common ancestral molecule. Prolactins and growth hormones are believed to have diverged about 400 million years ago, hence the presence of distinct prolactins and growth hormones in fish. Placental lactogens are only observed in mammals, and it has been hypothesized that primate PLs evolved from the growth hormone lineage and non-primate PLs from the prolactin one. The protein hCS is thought to have evolved by gene duplication from hGH. There are also somatolactins in fish, with sequences intermediate between those of prolactin and GH.

The mature growth hormones, prolactins, and placental lactogens are typically composed of 190-200 residues, with molecular weights of 22,000-23,000 daltons. However, these sizes are not required; e.g., mature flounder GH is not more than 173 residues long.

The amino acid sequences of these proteins are too similar to have arisen by chance alone; a BlastP search, using mature hGH as the query sequence, with the default scoring matrix (Blosum62) and gap penalties (11 creation/1 extension), and no low complexity filter, yields an E value of 1e-106, 9e-90 for the alignment with human placental lactogen (prf 731144A), and 6e-11 for the alignment with human prolactin (ref NP_000939.1).

Functional considerations also justify the definition of the growth hormone-placental lactogen-prolactin superfamily. Even if there is also a distinct placental lactogen receptor, see Freemark, J. Clin. Investig., 83: 883-9 (1989), the effect of placental lactogens on the prolactin receptor is significant. Classically, the GH receptor is the specific receptor for GH, and the prolactin (a.k.a. lactogen) receptor is the specific receptor for prolactin and placental lactogen. However, primate GHs can bind to the prolactin receptor with high affinity, and some non-human mammalian placental lactogens can bind to the somatogen (GH) receptor. Reference may also be made to the structural similarities of the GH and prolactin receptor proteins. See Goffin, et al., "Sequence-Function Relationships Within the Expanding Family of Prolactin, Growth Hormone, Placental Lactogen, and Related Proteins in Mammals", Endocrine Revs., 17(4): 385-410 (1996); Nicoll, et al., "Structural Features of Prolactins and Growth Hormones that Can Be Related to Their Biological Properties", Endocrine Revs., 7(2): 169-203 (1986).

For the purpose of the present application, the GH-PRL-PL superfamily is composed of all proteins which, when aligned to hGH (mature portion of ref NP_000506.2) by BlastP as set forth above, yield an alignment for which the E value is less than (i.e., better than) e-06.

The growth hormones (GHs) are a family of vertebrate proteins with about 191 amino acid residues, the number varying from species to species. There are four cysteine residues, and two disulfide bridges. See generally Harvey, et al., *Growth Hormone* (CRC Press: 1995). The amino acid sequence of the growth hormones isolated from various vertebrate species are highly conserved. In the aforementioned BlastP search, the E value for alignments of mature hGH with a few of the many other database GHs were as follows (best alignment for each species cited): 1e-106 (*Pan troglodytes*), 3e-97 (*Caallithrix jacchus*, common marmoset), 3e-68 (*Balaenoptera borealis*, fin whale; *Delphinus delphis*, common dolphin; *Hippopotamus amphibius*), 4e-68 (*Canis familiaris*, dog; *Sus scrofa domestica*, pig), 2e-67 (*Mus musculus*), 1e-66 (*Rattus norvegicus*, Norwegian rat; *Oryctolagus cuniculus*, domestic rabbit; *Cavia porcellus*, guinea pig), 2e-65 (*Capra hircus*, goat; *Giraffa camelopardalis*, giraffe; *Bos taurus*, bovine); 3e-65 (*Ovis aries*, domestic sheep); 4e-59 (*Crocodulus novaeguineae*), 4e-58 (*Chelonia mydas*), 5e-58 (*Gallus gallus*, chicken); 2e-55 (*Tarsius syrichta*, Philippine tarsier) (a relative high E value for a mammal); 1e-53 (*Lepisosteus osseus*, a bony fish); 8e-08 (*Torpedo californica*). The best scoring somatolactin is sp P20362, E value of 2e-18. The best (lowest) E value is that which would be obtained if the query and database sequence were identical (or if one comprised the other); in a recent search in which the query sequence was the mature HGH, the best E value was that for the alignment of the mature HGH with the database HGH precursor (ref NP_000506.2): 1e-106.

If the E value for an alignment is low, the alignment score must have been high relative to those which would occur by chance alone. The alignment score for each alignment is calculated by adding up the individual amino acid pair scores dictated by the scoring matrix, and subtracting the appropriate gap penalties for any gaps. The alignment algorithm introduces gaps only if they result in a net improvement in the overall alignment score. In the scoring matrix, identities tend to have the higher values, and hence alignments with high alignment scores will also tend to be characterized as having high percentage identities. However, alignments ranked by alignment score will not necessarily have the same order as if those same alignments were ranked by percentage identity.

In BlastP, the percentage identity is calculated as being the number of identities expressed as a percentage of the length of the "overlap", the aligned region. This region begins and ends with aligned amino acid pairs (not necessarily identical) and may include one or more gaps in either or both sequences. A gap occurs where one or more consecutive amino acids inside one sequence are left unpaired with amino acids in the other sequence (this may be symbolized by aligning each of them with a null symbol, such as a hyphen, in that other sequence). The calculated length of the overlap region is the sum of the number of aligned pairs and the lengths of the gaps. If one sequence overhangs another, the overhang is an end-gap, outside the overlap region, and does not count in calculating the percentage identity.

The following are examples of the BlastP percentage identity of human GH (ref NP_000506.2) with other members of the GH-PRL-PL superfamily: human placental lactogen (85%, 161/189), whale, dolphin and hippopotamus GH (67%, 130/192, 3/192 in gaps), pig GH (67%, 130/193, 3/192 in gaps), mouse GH (65%, 126/192, 3/192 in gaps), bovine GH (66%, 127/192, 3/192 in gaps), crocodile GH (59%, 113/190, 3/190 in gaps), chicken GH (57%, 110/190, 3/190 in gaps), Syrian hamster GH (62%, 108/172, 2/172 in gaps), *Lepisosteus osseus* GH (54%, 102/186, 3/186 in gaps), Japanese flounder (27%, 53/190, 8/190 in gaps), human prolactin (23%, 45/191, 12/191 in gaps).

The overall percentage identity of bovine growth hormone with other non-primate, mammalian growth hormones is very high: porcine (92%), ovine (99%), and rat (87%). Watahiki, et al., J. Biol. Chem., 264:312 (1989) compared the sequences of flounder, yellowtail, tuna, salmon, chicken, rat, porcine, ovine, bovine and human growth hormones. Watahiki's FIG. 3 identifies residues conserved among the GHs and residues predicted to be important for the manifestation of growth-promoting activity. He identified five conserved domains which he labeled GD1-GD5. Mutations in these conserved domains are more likely to affect activity.

The 3-dimensional structures of two GHs are known, and they are quite similar. Porcine GH is a single domain protein arranged as a four helix bundle with the helices in an antiparallel (up-up-down-down) relationship. Its four helixes are made up of residues 7-34, 75-87, 106-127 and 152-183. See Abdel-Meguid et al., Proc. Nat. Acad. Sci. USA 84: 6434 (1987). Human growth hormone features a bundle of four major helices (9-34, 72-92, 106-128, and 155-184), connected by loops (35-71, 93-105 and 129-154). Loop 1 (between helices 1 and 2) comprises mini-helices at 38-47 and 64-70, and Loop 2 (between helices 2 and 3) one at 94-100. Reference to helices 1-4 of hGH is a reference to the major helices, not to the mini-helices. Helix 2 is kinked at Pro-89. See DeVos, et al., Science, 255:306-312 (1992).

The other GHs are also believed to be four-helix proteins, on the basis of secondary structure prediction methods, sequence alignment, and knowledge of the 3-D structures of pGH and/or hGH. For example, bovine growth hormone is 92% homologous at the amino acid sequence level with porcine growth hormone, and bGH's structure has been deduced by study of the two sequences and of the structure of porcine growth hormone. Its four alpha helices have been reported to be assumed by amino acids 4-33, 66-80, 108-127 and 150-179. The third alpha helix of bGH is defined as amino acids 106-129. However, it will be noted that the ends of this helix have a less marked alpha helical secondary structure than does the central region, which is 109-126. The exact bounds of the third alpha helix may differ for other GH's, depending on the alpha helical tendencies of the "end" amino acids. The conformation is reasonably consistent with the predictions made by Chen and Sonenberg, Biochemistry, 16:2110 (1977) using the method of Chou and Fasman, Biochemistry, 13:222 (1974) (AAs 10-34, 66-87, 111-127, 186-191). For preliminary work in determining the 3-D structure of bGH, see Bell, et al., J. Biol. Chem., 260:8520-25 (1985).

Growth hormones can have considerable inter-species cross-reactivity. In general, the trend is for "higher" growth hormones to activate "lower" GH receptors, but not the reverse. Human GH is active in nonhuman mammals, but nonhuman, nonprimate GHs are generally inactive in humans. Bovine GH is active in the horse (see De Kock, et al., J. Endocrinol., 171(1): 163-171 (2001)). Mammalian and bird GHs are active in fish, see Gill, et al., Biotechnology, 3:643 (1985) reported that recombinant chicken and bovine growth hormones accelerate growth in juvenile pacific salmon. Mutation of a nonhuman GH, to increase its similarity to human GH, will render it more likely to be active against the human GH receptor. For studies of the structural origins of species specificity in GH or its receptor, see Liu, et al., "Episodic Evolution of Growth Hormone in Primates and Emergence of the Species Specificity of Human Growth Hormone Receptor", *Mol. Biology & Evolution,* 17: 945-53 (2001); Allan, et al., "Identification of Novel Sites in the Ovine Growth Hormone Receptor Involved in Binding Hormone and Conferring Species Specificity", *Eur. J. Biochem.,* 261 (2): 555-62 (1999).

Human placental lactogen has an overall sequence identity with hGH of 85%, but its binding to hGH by is ~2,000-fold weaker. WO97/11178 at p. 100. For a comparison of placental lactogens, see Forsyth, Exp. Clin. Endocrinol., 102(3): 244-51 (1994).

Human prolactin is a 199-residue (23 kDa protein), with 23% identity (BlastP) to human GH. The 3-D structure of human prolactin has been determined; as expected, it has four primary helices, with an up-up-down-down topology, just as does human growth hormone. There are also interesting differences. The first extended loop of hPRL is missing the first of the two mini-helices found in the comparable loop of hGH, while the second mini-helix deviates in angle from its hGH counterpart. Both hPRL and hGH have a short loop connecting the primary helices 2 and 3, but the loop is shorter in hPRL, and there is no component mini-helix. Finally, the N-terminal of hPRL is longer than that of hGH, and contains a short disulfide-linked loop. See Keeler, et al., "The Tertiary Structure and Backbone Dynamics of Human Prolactin", *J. Molec. Biol.,* 328: 1105-221 (2003). In Keeler's FIG. 1, HGH Gly-120 is aligned with hPRL Gly-129. G129X mutants of hPRL are known to exhibit prolactin receptor antagonist activity, see below.

Growth Hormone (Somatotropic) Receptor

The hGH receptor belongs to a large family of receptors of hematopoietic origin, which includes interleukin-3 and granulocyte colony stimulating factor receptors. For purification and characterization of a human growth hormone receptor, see Leung, et al., Nature, 330:537-43 (1987).

The extracellular domain of the hGH receptor is designated hGHbp. The affinity (Kd) of hGH for hGHbp was reported by Cunningham et al. (1989) to be 0.34 nM. WO92/03478 reports the affinity of hGH for the hGHbp in the presence of EDTA is such that the Kd is 0.42 nM, while in the presence of $ZnCl_2$ the affinity is reduced (KD of 1.6 nM). It also reports that the affinity of hPRL for the hGHbp is extremely low (KD>100,000 nM whether in presence of EDTA or $ZnCl_2$, see Table 1). The affinity of hPL for hGHbp is very low (949.2 nM, Table 13), but not as low as that of hRPL.

3D Structure of GH: GH Receptor Complexes

The 3D structure of the hGH:hGHbp complex is also known (see Wells and DeVos, Ann. Rev. Biophys. Biomol. Struct., 22: 329-51 (1993) and DeVos, et al., Science, 255:306 (1992)). These researchers examined the complex of hGH and the extracellular domain of its receptor (hGHR) by X-ray diffraction. The complex had the form hGH $(hGHR)_2$; that is, the receptor dimerizes to interact with hGH.

The first receptor-binding region ("site 1") of hGH is concave and is formed mainly by residues on exposed faces of helix 4, but also by exposed residues of helix 1 and residues in the region connecting helices 1 and 2. The second receptor-binding region ("site 2") comprises the exposed sides of helices 1 and 3 and is relatively flat. The role of the helix 3 is shown best in DeVos' FIG. 5; there is a significant decrease in solvent accessibility around hGH E119 upon complex formation. GH antagonists that are GH mutants with mutations corresponding to bGH119X (or hGH120X) appear to interfere with receptor dimerization.

The site 1 residues of hGH are H18, H21, Q22, F25, K41, Y42, L45, Q46, P61, S62, N63, E66, R167, K168, D171, K172, I175, R178, C182 and C189. The site 2 residues are T3, I4, L6, L9, N12, L15, r16, R19, Q22, Y103, N109, D116, D119, G120 and T123. See Tables 4 and 5 of U.S. Pat. No. 5,506,107 for details on the nature of the interactions between these residues and hGHbp.

According to the X-ray structure of the hgh(hGHbp)$_2$ complex, the two HGHbp's contact each other at Ser201. Consequently, an hGHbp(S201C)-matrix can be used to test variants of hGH for binding to site 1 alone. See WO97/11178.

Prolactin Receptor

The extracellular binding domain (AAs 1-211) of the prolactin receptor is designated hPRLbp. It is about 32% identical to hGHbp, see WO90/04788 p. 89. WO92/03478 initially reports (table 1) the affinity of hPRL for the hPRLbp in the presence of EDTA is such that the Kd is 2.1 nM, while in the presence of ZnCl2 the affinity is reduced (KD of 2.6 nM). However, in table 11 the affinity of hPRL for hPRLbp without zinc is said to be 2.8 nM.

Human GH also binds the human prolactin receptor. (See Boutin et al., Cell, 53: 69 (1988)). WO92/03478 reports the affinity of hGH for the hPRLbp in the presence of EDTA is such that the Kd is 270 nM, while in the presence of ZnCl2 the affinity is substantially increased (KD of 0.033 nM, i.e., 33 pM). Increased affinity is also observed for the single Ala substitution hGH mutants H18A (370 to 4.5 nM), H21A (200 to 3 nM), E174A (360 to 12 nM) and D171A (ND to 0.037 nM).

The hGH binding epitope for the prolactin receptor is composed of determinants in the middle of helix 1 (comprising residues F25 and D26), a loop region (including I58 and R64), and center portion of helix 4 (including K168m K172, E174, and F176). See WO90/04788 p. 56. This patch overlaps, but is not identical to, the hGH epitope for the hGH receptor. Binding affinities of various hGH mutants for hPRLbp in presence of ZnCl2 are given in Tables 7-9. WO92/03478, p. 13, suggests that the binding of zinc to the hGH:hPRLbp complex is mediated by hGH residues H18, H21 and E174.

The affinity of hPL for hPRLbp in the presence of ZnCl2 is 50 pM. In the absence of zinc the hPL precipitated. The hPRLbp affinities of hPL mutants D56E, M64R, E174A, M179I, D56E/M64R/M179I, and V4I/D56E/M64R/M179I are given in Table 12 of WO92/03478.

Hybrid Proteins and Homologue-Scanning Mutagenesis

Cunningham et al., Science 243: 1330-1336 (1989) used a technique called homologue-scanning mutagenesis to identify residues involved in the binding of hGH to hGHbp. In essence, selected segments of the hGH polypeptide were replaced with the corresponding segments (according to Cunningham's sequence alignment) of a homologous hormone (pGH, hPL or hPRL). This in effect created proteins which were hybrids of hGH and a homologous hormone. It should be noted that Cunningham did not always replace all residues of the target segment.

A comparison of the binding affinities of these mutants GHs and wild-type hGH to a cloned liver hGH receptor led to the conclusion that there were three discontinuous polypeptide determinants in hGH involved in receptor binding. They were located at the NH$_2$ terminus, the COOH terminus, and within a loop between amino acid residues 54 and 74. These putative binding domains were further analyzed by an alanine-scanning mutagenesis technique in which alanine residues were systematically substituted throughout those regions (see below).

The mutations introduced into hGH by Cunningham are set forth below:

| Region probed | Mutant Name | Mutations Introduced | hGH bp Bind Kd (nM) | hPRL bp Bind Kd (nM) |
|---|---|---|---|---|
| | w+hGH | None | 0.34 | 2.3 |
| A11-33 | hPL(12-25) | N12H, F25L | 1.4 | ND |
| | pGH(11-33) | D11A, M14V, H18Q, R19H, F25A, Q29K, E33R | 1.2 | 852 |
| | hPRL(12-33) | N12R, M14V, L15V, R16L, R19Y, F25S, D26E, Q29S, E30Q, E33K | 3.6 | ND |
| | hPRL(12-19) | N12R, M14V, L15V, R16L, R19Y | 5.8 | 3.2 |
| | hPRL(22-33) | Q22N, F25S, D26E, Q29S, E30Q, E33K | 0.29 | 168 |
| B46-82 | hPL(46-52) | Q46H, N47D, P48S, Q49E, L52F | 2.5 | 4.4 |
| | pGH(48-52) | P48A, T50A, S51A, L52F | 0.94 | 2.0 |
| C54-74 | hPL(56-64) | E56D, R64M | 10 | 41 |
| | pGH(57-73) | S57T, T60A, S62T, N63G, R64K, E65D, T67A, K70R, N72D, L73V | 5.8 | 167 |
| | hPRL(54-74) | F54H, S55T, E56S, I58L, P59A, S62E, N63D, R64K, E66Q, T67A, K70M, S71N, N72Q, L73K, E74D | 23 | 2.5 |
| D88-104 | hPRL(88-95) | E88G, Q91Y, F92H, R94T, S95E | 0.47 | 3.8 |
| | hPRL(97-104) | F97R, A98G, N99M, S100Q, L101D, V102A, Y103P, G104E | 0.53 | 12.1 |
| E108-136 | hPL(109-112) | N109D, V110D, D112H | 0.61 | ND |
| | hPRL(111-129) | Y111V, L113I, K115E, D116Q, E118K, E119R, G120L, Q122E, T123G, G126L, R127I, E129S | 0.52 | 2.6 |
| | hPRL(126-136) | R127D, L128V, E129H, D130P, G131E, S132T, P133K, R134E, T135N | 0.58 | ND |

| Region probed | Mutant Name | Mutations Introduced | hGH bp Bind Kd (nM) | hPRL bp Bind Kd (nM) |
|---|---|---|---|---|
| F164-190 | pGH(164-190) | Y164S, R167K, M170L, D171H, V173A, F176Y, I179V, V180M, Q181K, S184R, i184f, G187S, G190A | ≥34 | ND |
| | pGH(167-181) | R167K, D171H, I179V, Q181K | 9.2 | ND |
| | w+ hPRL | None | $10^5$ | 7.6 |

The first four columns are based on Cunningham et al. (1989), and the last column on Table XVIII of WO90/04788.
The hGHbp data for w+ hPRL is also from WO90/04788.
The data for w+ hGH binding hGH bp is from Table III of WO94/04788.

First Ala Scanning Mutagenesis Study

Alanine scanning mutagenesis was first described by Cunningham and Wells ("High-Resolution Mapping of hGH-Receptor Interactions by Alanine Scanning Mutagenesis", Science 284: 1081 (1989)). In view of the results of homologue scanning mutagenesis, their study was directed to residues 2-19, 54-75, and 167-191. Amino acid residues at positions 10, 58, 64, 68, 172, 174, 175, and 176 of hGH were shown to be important for GH receptor binding. However, none of the single Ala substitution mutant GHs tested were reported to inhibit growth.

Based on the alanine scanning mutagenesis, preferred replacement amino acids for hGH residues F10, F54, E56, I58, R64, Q68, D171, K172, E174, T175, F176, R178, C182 and V185 are listed in Table IV, p. 52, of WO90/04788. These residues are those for which the alanine substitution resulted in a more than four-fold effect on the Kd. Table V of the same reference listed the residues for which the alanine substitution resulted in a less than two fold effect, and Table VI those for which it had a favorable effect. Table X sets forth suggested replacement AAs for hGH residues S43, F44, H18, E65, L73, E186, S188, F191, F97, A98, N99, S100 L101, V102, Y103, G104, R19, Q22, D26, Q29, E30 and E33.

hGH174 Study

Since the mutation E174A resulted in a substantial increase in hGH:hGHbp affinity, twelve alternative substitutions at this site were tested for activity. Side chain size appeared to be the major factor determining affinity. The optimal AA remained Ala (0.075), followed by Ser (0.11), Gly (0.15), Gln (0.21), Asn (0.26), Glu (wild type, 0.37), His (0.43), Lys (1.14), Leu (2.36) and Tyr (2.9). There was no expression of E174D or E174R. See Table 6 of WO92/03478.

Second Ala Scanning Mutagenesis Study

Residues K41, Y42, L45 and Q46, which belong to the first minihelix, were not evaluated in the first study, and hence were studied subsequently. Kd values are given in Table 3 of U.S. Pat. No. 5,534,617. WO97/11178 comments at p. 106 that "a starting point for efficient optimization of affinity is a complete alanine scan of the relevant interface."

Double Mutants

Several double mutants were prepared with the intent of altering hGH/hPRL receptor preference. For wt hGH, binding is 2.3 nM to hPRLr and 0.34 to hGHr. For K168A/E174A, the values are 1950 and 0.09, and for K172A/F176A, they are ~40,000 and 190. These double mutants thus evidence increased preference for hGHr over hPRLr. See WO90/04788.

Additivity of Single Substitution Effects

Table XXI OF WO90/04788 analyzes the additivity of the effects of various single substitutions on binding to the hGH or hPRL receptors. These effects are characterized as being "strikingly additive."

Helix-4a Library

A combinatorial library of mutants was prepared in which wild type hGH was randomized at residues K172, E174, F176 and R178. These residues were targeted for random mutagenesis because they all lie on or near the surface of hGH, contribute significantly to receptor binding as shown by Ala scanning mutagenesis, lie within a well defined structure occupying two turns on the same side of helix 4, and are each substituted by at least one amino acid among known evolutionary variants of hGH. See p. 32 of WO92/09690. The mutants selected by competitive binding to hGHbp were KSYR (SEQ ID NO: 99) (0.06 nM), RSFR (SEQ ID NO: 100) (0.10), RAYR (SEQ ID NO: 101) (0.13), KTYK (SEQ ID NO: 102) (0.16), RSYR (SEQ ID NO: 103) (0.20), KAYR (SEQ ID NO: 104) (0.22), RFFR (SEQ ID NO: 105) (0.26), KQYR (SEQ ID NO: 106) (0.33), KEFR (SEQ ID NO: 107) (wild type, 0.34), RTYH (SEQ ID NO: 108) (0.68), QRYR (SEQ ID NO: 109) (0.83), KKYK (SEQ ID NO: 110) (1.1), RSFS (SEQ ID NO: 111) (1.1) and KSNR (SEQ ID NO: 112) (3.1), with, e.g., "KSYR" (SEQ ID NO: 99) denoting K172, S174, Y176 and R178. The tightest binding mutant (E174S, F176Y) had an affinity about six-fold higher than wild-type hGH. See table VII of WO92/09690.

For sequences of some non-selected mutants (thereby illustrating the diversity of the library), see Table VI of U.S. Pat. No. 5,780,279. These mutants should have lower hGHbp affinity than the selected mutants, but are not necessarily entirely non-binding.

Helix-4b Library

A combinatorial library of mutants was prepared in which the mutant hGH (E174S, F176Y) was randomly mutated at R167, D171, T175 and I179. Table XI of WO92/09690 shows that N, K, S, D, T, E and A were all accepted at 167 (wt=R); S, N and D at 171 (wt=D); T, A and S at 175 (wt=T); and T, N, Q, I and L at 179 (wt=I).

Some mutations were over-represented among the selected clones compared to the expected frequency of those mutations in the library based on the codon (NNS) used to encode them. This over-representation may be expressed in standard deviation units by (observed frequency−expected frequency)/standard deviation. In the 56 clones sequenced, the over-represented mutations (with a score of at least 2.0 standard deviation units) were R167N (25.6 sd), R167K (4.1), D171S (14.1), D171 (4.8), D171N (4.1), T175 (29.1), I179T (18.6), I179N (4.1). See Table 4 of U.S. Pat. No. 5,534,617. The best library member was a pentamutant (R167D, D171S, E174S, F176Y, I179T), with three new mutations relative to the two mutation background, which bound hGH receptor about 8-fold better than wild-type hGH.

Helix-1 Library

A combinatorial library of mutants was prepared in which wild-type hGH was randomly mutated at F10, M14, H18 and H21. After 4 rounds of selection, a tetramutant (F10A, M14W, H18D, H21N) was isolated which bound the receptor about 3-fold better (Kd 0.10 nM) than wild-type hGH. In the 68 clones sequenced, the following amino acids were over-represented at the mutated positions with a score of at least 2.0 standard deviation units: F10A (12.0 sd), F10 (10.4 sd), F10H (6.2 sd), M14W (11.1), M14S (4.8), M14Y (2.7), M14N (2.7), M14H (2.0), H18D (18.8), H18F (4.1), H18N (3.4), H21N (20.2), and H21 (4.8). See Table 4 of U.S. Pat. No. 5,534,617. More generally, Table VIII of WO92/09690 shows that H, A, Y, L, I, and F were all accepted at position 10, G, W, T, N and S at 14; N, D, V, I S, and F at 18, and N, H, G and L at 21.

Minihelix-1 Library

A combinatorial library of mutants was prepared in which wild type hGH was mutated at minihelix-1 positions K41, Y42, L45 and Q46. Results are shown in Table 4 of U.S. Pat. No. 5,534,617. Seventeen clones were sequenced. By the standard deviation criterion there was a mild-preference (3.7 std. dev. units) for K41R, a slight preference for Y42R (2.0 sd) or Y42Q (2.0 sd), a strong preference for L45W (4.8 sd) or wild type L45 (4.5 sd), and a stronger preference for Q46W (7.6). Also observed were K41F (2.0 sd), Q46F (2.0 sd) and Q46Y (2.0 sd). The best of the library member was clone 835.A6 (41I, 42H, 45W, 46W), with a 4.5-fold improved affinity over wild-type hGH. See Table 5 of U.S. Pat. No. 5,534,617.

Loop-A Library

A combinatorial library of mutants was prepared in which wild-type hGH was randomly mutated at loop-A positions F54, E56, I58 and R4. In the 26 clones sequenced, the over-represented mutations (at least 2 sd) were F54P (14.1 sd), E56D (4.7), E56W (4.7), E56Y (2.5), 158 (8.1), 158V (3.5) and R64K (22.8). The R64K mutant, found in 81% of the clones, was previously known to by itself cause a 3-fold improvement in affinity. The best of the library members tested was the tetramutant (F54P, E56D, 158T, R64K), which had a 5.6-fold greater affinity than wild type hGH.

Combinatorial Library Use, Generally

WO97/11178 comments (p. 107) that ideally one should randomize residues which contact each other in the same mutagenesis step so that they are allowed to co-vary. While such covariation allows the detection of non-additive multiple substitution effects, most improvements were simple additive effects. See WO97/11178, p. 108.

Noncombinatorial Multiple Substitution Mutants

Various combinations of the following subcombinations of multiple mutations were synthesized and tested as shown in Table 6 of U.S. Pat. No. 5,534,617:
 A=F10H, M14G, H18N, H21N
 B=F10A, M14W, H18D, H21N (0.10)
 C=M14S, H18F, H21L (0.68)
 D=R167N, D171S, E174S, F176Y, I179T (0.04)
 E=R167E, D171S, E174S, F176Y (0.04)
 F=R167N, D171N, E174S, F176Y, I179T (0.06)
 852b=K41I, Y42H, L45W, Q46W, F54P, R64K (0.0079)

Combinations of the Helix-1 variants A, B or C, with the Helix-4-b variants D, E or F, were prepared. The variant A, and combinations AD, AE and AF, formed disulfide dimers and hence were not pursued further. Variant C also formed a disulfide dimer, but CD, CE and CF did not. It is unclear whether BE was prepared; no reference to it is made.

The tested combinations, and their Kd values (nM), were BD (0.01), CD (0.011), CE (0.014), BF (0.016), CF (0.021) and 852d (BD+852b)(0.0009). Note that 852d differs by 15 substitutions from wild-type hGH.

Joint Selection Combinatorial Library

Some attempt has been made to combinatorially explore simultaneous helix-1 and helix-4 mutations. Mutating four residues in helix-1 and 4 residues in helix 4 so as to systematically explore all 20 possible AAs at each of these eight positions would mean preparing a pool of 1.1e12 DNA sequences which by NNS degeneracy encode 2.6e10 different polypeptides. Obtaining a random phagemid library large enough (perhaps e13 transformants) to assure representation of all variants was not feasible in 1991.

Consequently, a library was constructed by randomly ligating selected DNA pools from the helix-1 and helix-4b library screens, and nondegenerate DNA to complete the coding sequence, so as to create a combined pool. There would be some amount of diversity in each of the donor pools. The results are shown in Table XIII-A of WO92/09690. See also Table 7 of WO97/11178.

Third Alpha Helix Mutants of Growth Hormones which Function as GH Antagonists

Mutants of hGH and bGH which function as GH antagonists were first identified in Kopchick et al. Kopchick et al. discovered that mutation of Gly119 in bGH to Arg ("G119R"), Pro ("G119P"), Lys ("G119K"), Trp ("G119W") or Leu ("G119L"), or the homologous Gly120 in hGH to Arg or Trp, results in a mutein (mutant protein or peptide fragment thereof) which has growth-inhibitory activity in vertebrates, especially mammals.

Kopchick et al. discovered that the bGH mutants, when expressed in transgenic mice, resulted in mice with a growth ratio of between 0.57 and 1.0. The growth ratio of the mice was negatively correlated with the serum level of the bGH analog, i.e., as the serum level of the bGH analog increased, the growth ratio of the animals decreased. Also, these analogs, when expressed to NIH-3T3-preadipocytes, did not result in stimulation of preadipocytes differentiation, whereas native GH will promote this differentiation. In fact, these analogs will antagonize the ability of wild type GH to promote preadipocyte differentiation. Kopchick et al. referred to these analogs as "functional antagonists."

Kopchick et al. also generated transgenic mice which express either wild type hGH, hGH G120A, hGH G120R and hGH G120W. Mice which express hGH G120A show a growth enhanced phenotype similar to mice which express wild type hGH. In contrast, substitution of R or W for G at position 120 in hGH, and subsequent expression in transgenic mice, results in animals with a growth ratio between 0.73 and 0.96, and whose level of serum hGH is negatively correlated with the growth phenotype; i.e., as the serum levels of these hGH 120 analogs increase, the growth ratios decrease.

It has since been shown by Genentech researchers that the G120R mutant of hGH binds to hGHbp, and that its affinity for hGHbp(S237C) was Kd=1.6 nM, and for hGHbp (S201C) was Kd=2.7 nM. In the same experiment, the KD for the binding of wild type hGH to hGHbp (S201C) was 0.9 nM. It is important to note when hGh and bGH are aligned according to commonly accepted principles of sequence alignment, that the glycine residue in bGH at position 119 is aligned with (i.e., corresponds to) the glycine residue in hGH at position 120. They are both located in the central portion of the third alpha helix.

The preferred growth-inhibitory mutants are characterized by a modification of the surface topography of the third alpha helix. In the third alpha helix of "wild-type" bovine growth hormone, there is a surface cleft or depression beginning, at the Aspartate-115, deepening at the Glycine-119, and ending with the Alanine-122. All of the mutants discussed in the references cited in this section, both those which retain the wild-type growth-promoting activity and those which do not, are consistent with the theory that growth-promoting activity requires the presence of this cleft or depression and that, if the center of this cleft is "filled in" by substitution of amino acids with bulkier side chains, the mutein inhibits the growth of the subject.

With respect to amino acid 119, glycine is both the smallest amino acid residue and the one least favorable to alpha-helix formation. Thus, it is believed that any other amino acid may be substituted for it without destabilizing the alpha helix, while at the same time filling in the aforementioned cleft. All of the G119 bGH substitutions tested resulted in a "small animal" phenotype. These substitutions were arginine (a large, positively charged AA), proline (a cyclic aliphatic AA), lysine (a large, positively charged AA), tryptophan (a large aromatic AA) and leucine (a large, nonpolar, aliphatic AA).

In hGH, the homologous glycine is at position 120. Substitution of arginine or tryptophan resulted in an antagonist, however, hGH G120A retained growth-promoting activity. Consequently, it is presently believed that if antagonist activity is desired, this glycine, which is conserved in all vertebrate GHs, may be replaced by any amino acid other than alanine (the second smallest amino acid), and more preferably by any amino acid which is at least as large as proline (the smallest replacement amino acid known to result in a "small" animal phenotype).

Modification of position 115 is suggested by Kopchick et al.'s "cleft" theory. The aspartate at position 115 may be replaced by a bulkier amino acid, which does not destroy the alpha helix. Preferably, the replacement amino acid has a size greater than that of aspartate. The amino acids histidine, methionine, isoleucine, leucine, lysine, arginine, phenylalanine, tyrosine, and tryptophan are substantially larger than aspartate. Of these, His, Met, Leu, and Trp are more preferred because they combine the advantages of bulk with a reasonably strong alphahelical propensity. Note, however, that Glu is the strongest alpha-helix former of all of the amino acids. The D115A mutant of bGH is not a GH antagonist, but Alanine is smaller than Aspartic Acid, so this is not probative of the value of replacing Asp 115 with a bulkier amino acid.

It is possible to systematically screen for the effect of all possible amino acid substitutions at the position corresponding to bGH 119 alone, or at positions corresponding to bGH 115 and/or 119, too. It is possible that G119A will lead to a "small" phenotype if coupled with other mutations, e.g., at 115 and 122. Thus, one could screen a combinatorial library in which all library members contain the mutation G119A, and positions 115 and 122 are each varied thorough the 20 possible amino acids.

This approach may be extended, if desired, to other amino acid positions in the third alpha helix. Amino acids which are particularly preferred for screening are the six amino acids spatially nearest bGH's Gly119, that is, Ala122, Leu123, Ile120, Leu116, Asp115 and Glu118. Screening for the effects of all possible mutations of position 119 and these six proximate positions would require a library with $20^7$ members. If such a library cannot be prepared one could prepare 19 separate libraries, each characterized by a particular bGH G119X background mutation, and randomization of the six proximate positions (for $20^6$ different library members per library).

Besides the mutation at the position corresponding to bGH 119, which is deemed necessary to impart the desired growth-inhibitory activity, additional mutations are possible which will leave the growth-inhibitory activity or other antagonist activity intact. These mutations may take the form of single or multiple substitutions, deletions, or insertions, in nonessential regions of the polypeptide. For example, it is possible to alter another amino acid in the alpha helix if the substitution does not destroy the alpha helix. Preferably, such alterations replace an amino acid with one of similar size and polarity. It may be advantageous to modify amino acids flanking the primary mutation site 119 in order to increase the alpha-helical propensities of the sequence, particularly if the mutation at 119 is one expected to destabilize the helix.

The GH antagonist activity was manifested, not only in these single substitution mutants, but in multiple substitution mutants. The first such studied by Kopchick et al. was the bGH mutant E117L/G119R/A122D, which inhibited growth in transgenic mice. Mouse L cell secretion of the mutant protein was observed in the case of the bGH mutants E117/G119R, E111L/G119W, E111L/G119W/L121R/M124K, E111L/G119W/R125L, and E111L/G119W/L121R/M124K.

B2024 and B2036 GHA Mutants

In view of the foregoing mutational analyses, two mutants of hGH were singled out for special attention. The B2024 mutant is characterized by the mutations H18A, Q22A, F25A, D26A, Q29A, E65A, G120K, K168A, and E174A. The B2036 mutant is characterized by the mutations H18D, H21N, G120K, R167N, K168A, D171S, K172R, E174S, and I179T. In both cases, the boldfaced mutation imparts antagonist activity and the other mutations improve "site 1" binding to the hGH receptor. See WO 97/11178.

The B036 mutant may be compared with the 852d GH agonist mutant described previously. The R64K mutation of 852d was omitted to protect site 1 binding residues from PEGylation. Likewise, the mutations K168A and K172R were added to B2036 to reduce the number of site 1 PEGylation sites. Some of the mutations of 852d were omitted from B2036 because they make only modest enhancements to affinity, and their omission was considered likely to reduce antigenicity in humans. The B2024 mutant carries this theme further, omitting additional mutations. Both B2036 and B2024 could be converted into agonists by reversing the G120 mutation.

In a cell-based assay of antagonist activity, non-PEGylated B2036 had an IC50 of 0.19 ug/ml, while the IC50 for a PEGylated form (PEG-4/5-B2036) of B2036 was 13.1 ug/ml. Later, it was shown that another PEGylated form, PEG(20, 000)-B2036, had an IC50 of 0.25 ug/ml. See WO97/11178 at p. 135. Both PEGylated and non-PEGylated forms of B2036 have been shown to reduce IGF-1 levels in rhesus monkeys. WO97/11178 at p. 136. (See, generally, Ross et al., JCE, 2001, vol 86, pages 1716-1723, for its discussion of PEGylated growth hormones and their binding.)

Chemically Modified (Including PEGylated) GH Agonists and Antagonists

In order to reduce immunogenicity and/or increase half-life, a polyol can be conjugated to a GH agonist or antagonist at one or more amino acid residues, e.g., lysine(s). See WO93/00109. Suitable polyols include, but are not limited to, those substituted at one or more hydroxyl positions with a chemical group, such as an alkyl group having between one and four carbon atoms. Typically, the polyol is a poly(alkylene) glycol, such as poly(ethylene) glycol (PEG). The process of conjugating PEG to hGH (or a hGH mutant) is called PEGylation, but the process is also applicable to conjugation of other polyols. Preferably, the PEG has a molecular weight of 500 to 30,000 daltons, with an average molecular weight of 5,000 D being especially preferred.

Preferably, the process is such that two to seven, more preferably four to six, molecules of PEG are conjugated to each molecule of hGH (or mutant). The final composition may be homogeneous, i.e., all molecules bear the same number of PEGs at the same PEGylation sites, or heterogeneous, i.e., the number of PEGs or the sites of attachment of the PEGs varies from conjugate to conjugate.

Preferably, the reaction conditions are such that the conjugation does not destroy site 1 binding activity. Also, if the conjugate is to be used as a GH agonist, the conjugation should not destroy site 2 binding activity. See generally WO97/11178. Note that the G120K mutation contemplated above provides an additional PEGylation site.

Prolactin Mutants

Based on the data set forth above, Cunningham, et al., Science, 247: 1461 (Mar. 11, 1990) designed a human prolactin octamutant, which bound hGHbp (Kd of 2.1 nM) more than 10,000-fold more strongly than does wild type human prolactin (Kd >40,000). This hPRL octamutant bound hGHbp about one-sixth as strongly as wild type hGH (Kd of 0.34 nM), yet has only 26% overall sequence identity with hGH. The octamutant was characterized by the mutations (hGH numbering, Cunningham hGH:hPRL alignment) H171D, N175T, Y176F, K178R, E174A, E62S, D63N, and Q66E. The additional mutation L179I did not alter the affinity. WO90/04788 suggests the possibility of improving the binding further with the mutations V14M and H185V, see P. 113.

Mutational Studies Inspired by the Comparison of hGH and hPL

Within the three regions (hGH residues 4-14, 54-74, 171-185) which were identified by Ala scanning mutagenesis as constituting the hGHr binding epitope of hGH, hPL differs at only seven positions from hGH, as follows: P2Q, 14V, N12H, R16Q, E56D, R64M, and I1179M, where, e.g., "P2Q" means that the proline at position 2 of hGH is replaced with Q in the corresponding AA of aligned hPL. All of these seven positions were Ala-scanned in hGH, and four of the Ala substitutions (I4A, E56A, R64A, and I179A) resulted in a two-fold or greater reduction in binding affinity.

The hGH single substitution mutant I179M reduced hGH affinity by just 1.7 fold (as compared to 2.7 fold for I179A). The R64A and R64M mutations both caused 20-fold reductions in affinity. The hGH double mutant E56D/R64M evidenced a total reduction in affinity of 30-fold.

Placental Lactogen Mutants

Wild type hPL binds hGHbp(S201C) with an affinity (KD) of 1800 nM, while wild type hGH binds the same target with an affinity of 1.4 nM. The mutant hPL (0274), characterized by the mutations 10Y, 14E, 18R, 21G, binds hGHbp (S201C) with an affinity of 1.1 nM, i.e., superior to that of wild type hGH. See WO97/11178, Table 9 on p. 101.

WO90/04788 p. 116 says that the double mutant D56E, M64R in hPL substantially enhances its binding affinity for the hGH receptor, and also suggests the additional modifications M179I and V4I. The G120R variant of hPL inhibits hGH-stimulated growth of FDC-P1 cells transfected with the hPRL receptor. The IC50 for G120R-hPL is about 8-fold higher than for G120R-hGH. See Fuh & Wells, J. Biol. Chem., 270: 13133 (1995).

Beyond the growth hormone superfamily of proteins, variants of all of the peptides/polypeptides/proteins mentioned herein are specifically contemplated. Thus, any of the amino acids at any position can be modified by deletion/insertion/mutation. These variations can be made in addition to, or as part of, the glycosylation motif.

For Drug Delivery/Emulsification: Small hydrophobic or amphipathic proteins are tagged with the desired motif to make drug emulsifiers. Examples include but are not limited to, human serum albumin, including its individual domains. Of course, hSA can be made with glycomodules according to the invention, for any purpose or use, not just for drug delivery/emulsification.

The following modified proteins are specifically contemplated: 1) human growth hormone modified at the C- or N-terminus with (Ser-Hyp)$_n$ (SEQ ID NO: 113) where n is from about 1 to about 20, or about 2 to about 18, or about 4 to about 16, or about 6 to about 14, or about 8 to about 12, or about 10; 2) human prolactin modified at the C- or N-terminus with (Ser-Hyp)$_n$ (SEQ ID NO: 113) where n is from about 1 to about 20, or about 2 to about 18, or about 4 to about 16, or about 6 to about 14, or about 8 to about 12, or about 10; 3) human placental lactogen, modified at the C- or N-terminus with (Ser-Hyp)$_n$ (SEQ ID NO: 113) where n is from about 1 to about 20, or about 2 to about 18, or about 4 to about 16, or about 6 to about 14, or about 8 to about 12, or about 10; 4) interferon-2-alpha, modified at the C- or N-terminus with (Ser-Hyp)$_n$ (SEQ ID NO: 113) where n is from about 1 to about 20, or about 2 to about 18, or about 4 to about 16, or about 6 to about 14, or about 8 to about 12, or about 10; and 5) insulin, modified at the C- or N-terminus with (Ser-Hyp)$_n$ (SEQ ID NO: 113) where n is from about 1 to about 20, or about 2 to about 18, or about 4 to about 16, or about 6 to about 14, or about 8 to about 12, or about 10.

In some embodiments, N-terminal "insertions" are at the N-terminus of the mature or circulatory form of the various hormones. This placement may be desirable for proteins hormones that are found in the blood stream, which are generated by way of an amino terminal secretory peptide that is cleaved during the secretory process.

In addition to the specific proteins set forth above, antibodies, including monoclonal antibodies and humanized monoclonal antibodies, can also be expressed in accordance with the present invention. For example, glycosylated antibodies to growth hormone or to the growth hormone receptor can be made in accordance with the present invention.

Expression in Plants

The recombinant genes are expressed in plant cells, such as cell suspension cultured cells, including but not limited to, BY2 tobacco cells. Expression can also be achieved in a range of intact plant hosts, and other organisms including but not limited to, invertebrates, plants, sponges, bacteria, fungi, algae, archebacteria.

In some embodiments, the expression construct/plasmid/recombinant DNA comprises a promoter. It is not intended that the present invention be limited to a particular promoter. Any promoter sequence which is capable of directing expression of an operably linked nucleic acid sequence encoding at least a portion of nucleic acids of the present invention, is contemplated to be within the scope of the invention. Promoters include, but are not limited to, promoter sequences of bacterial, viral and plant origins. Promoters of bacterial origin include, but are not limited to, octopine synthase promoter, nopaline synthase promoter, and other promoters derived from native Ti plasmids. Viral promoters include, but are not limited to, 35S and 19S RNA promoters of cauliflower mosaic virus (CaMV), and T-DNA promoters from *Agrobacterium*. Plant promoters include, but are not limited to, ribulose-1,3-bisphosphate carboxylase small subunit promoter, maize ubiquitin promoters, phaseolin promoter, E8 promoter, and Tob7 promoter.

The invention is not limited to the number of promoters used to control expression of a nucleic acid sequence of interest. Any number of promoters may be used so long as expression of the nucleic acid sequence of interest is controlled in a desired manner. Furthermore, the selection of a promoter may be governed by the desirability that expression be over the whole plant, or localized to selected tissues of the plant, e.g., root, leaves, fruit, etc. For example, promoters active in flowers are known (Benfy et al. (1990) Plant Cell 2:849-856).

Transformation of plant cells may be accomplished by a variety of methods, examples of which are known in the art, and include for example, particle mediated gene transfer (see, e.g., U.S. Pat. No. 5,584,807 hereby incorporated by reference); infection with an *Agrobacterium* strain containing the foreign DNA-for random integration (U.S. Pat. No. 4,940,838 hereby incorporated by reference) or targeted integration (U.S. Pat. No. 5,501,967 hereby incorporated by reference) of the foreign DNA into the plant cell genome; electroinjection (Nan et al. (1995) In "Biotechnology in Agriculture and Forestry," Ed. Y. P. S. Bajaj, Springer-Verlag Berlin Heidelberg, Vol 34:145-155; Griesbach (1992) HortScience 27:620); fusion with liposomes, lysosomes, cells, minicells, or other fusible lipid-surfaced bodies (Fraley et al. (1982) Proc. Natl. Acad. Sci. USA 79:1859-1863; polyethylene glycol (Krens et al. (1982) Nature 296:72-74); chemicals that increase free DNA uptake; transformation using virus, and the like.

The terms "infecting" and "infection" with a bacterium refer to co-incubation of a target biological sample, (e.g., cell, tissue, etc.) with the bacterium under conditions such that nucleic acid sequences contained within the bacterium are introduced into one or more cells of the target biological sample.

The term "*Agrobacterium*" refers to a soil-borne, Gram-negative, rod-shaped phytopathogenic bacterium, which causes crown gall. The term "*Agrobacterium*" includes, but is not limited to, the strains *Agrobacterium tumefaciens*, (which typically causes crown gall in infected plants), and *Agrobacterium rhizogenes* (which causes hairy root disease in infected host plants). Infection of a plant cell with *Agrobacterium* generally results in the production of opines (e.g., nopaline, agropine, octopine, etc.) by the infected cell. Thus, *Agrobacterium* strains which cause production of nopaline (e.g., strain LBA4301, C58, A208) are referred to as "nopaline-type" *Agrobacteria*; *Agrobacterium* strains which cause production of octopine (e.g., strain LBA4404, Ach5, B6) are referred to as "octopine-type" *Agrobacteria*; and *Agrobacterium* strains which cause production of agropine (e.g., strain EHA105, EHA101, A281) are referred to as "agropine-type" *Agrobacteria*.

The terms "bombarding," "bombardment," and "biolistic bombardment" refer to the process of accelerating particles towards a target biological sample (e.g., cell, tissue, etc.) to effect wounding of the cell membrane of a cell in the target biological sample and/or entry of the particles into the target biological sample. Methods for biolistic bombardment are known in the art (e.g., U.S. Pat. No. 5,584,807, the contents of which are herein incorporated by reference), and are commercially available (e.g., the helium gas-driven microprojectile accelerator (PDS-1000/He) (BioRad).

The term "microwounding" when made in reference to plant tissue refers to the introduction of microscopic wounds in that tissue. Microwounding may be achieved by, for example, particle, or biolistic bombardment.

Plant cells can also be transformed according to the present invention through chloroplast genetic engineering, a process that is described in the art. Methods for chloroplast genetic engineering can be performed as described, for example, in U.S. Pat. No. 6,680,426, and in published U.S. Application Nos. 2003/0009783, 2003/0204864, 2003/0041353, 2002/0174453, 2002/0162135, the entire contents of each of which is incorporated herein by reference.

A variety of host cells are contemplated for use in this invention, including eukaryotic and prokaryotic cells. It is not intended that the present invention be limited by the host cells used for expression of the synthetic genes of the present invention. Generally, the present invention is contemplated in plants. As used herein, "plants" encompasses any organism that is photoautotrophic, which includes blue-green algae. Also specifically contemplated are green, red, and brown algae.

Plants that can be used as host cells include vascular and non-vascular plants. Non-vascular plants include, but are not limited to, Bryophytes, which further include but are not limited to, mosses (Bryophyta), liverworts (Hepaticophyta), and hornworts (Anthocerotophyta). Vascular plants include, but are not limited to, lower (e.g., spore-dispersing) vascular plants, such as, Lycophyta (club mosses), including Lycopodiae, Selaginellae, and Isoetae, horsetails or equisetum (Sphenophyta), whisk ferns (Psilotophyta), and ferns (Pterophyta).

Vascular plants include, but are not limited to, i) fossil seed ferns (Pteridophyta), ii) gymnosperms (seed not protected by a fruit), such as Cycadophyta (Cycads), Coniferophyta (Conifers, such as pine, spruce, fir, hemlock, yew), Ginkgophyta (e.g., *Ginkgo*), Gnetophyta (e.g., *Gnetum, Ephedra*, and *Welwitschia*), and iii) angiosperms (flowering plants—seed protected by a fruit), which includes Anthophyta, further comprising dicotyledons (dicots) and monocotyledons (monocots). Specific plant host cells that can be used in accordance with the invention include, but are not limited to, legumes (e.g., soybeans) and solanaceous plants (e.g., tobacco, tomato, etc.). Other cells contemplated to be within the scope of this invention are green algae types, Chlamydomonas, Volvox, and duckweed (Lemna).

The present invention is not limited by the nature of the plant cells. All sources of plant tissue are contemplated. In one embodiment, the plant tissue which is selected as a target for transformation with vectors which are capable of expressing the invention's sequences are capable of regenerating a plant. The term "regeneration" as used herein, means growing a whole plant from a plant cell, a group of plant cells, a plant part or a plant piece (e.g., from seed, a protoplast, callus, protocorm-like body, or tissue part). Such tissues include but are not limited to seeds. Seeds of flowering plants consist of an embryo, a seed coat, and stored food. When fully formed, the embryo generally consists of a hypocotyl-root axis bearing either one or two cotyledons and an apical meristem at the shoot apex and at the root apex. The cotyledons of most dicotyledons are fleshy and contain the stored food of the seed. In other dicotyledons and most monocotyledons, food is stored in the endosperm and the cotyledons function to absorb the simpler compounds resulting from the digestion of the food.

Species from the following examples of genera of plants may be regenerated from transformed protoplasts: *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Hyoscyamus, Lycopersicon, Nicotiana, Solanum, Petunia, Digitalis, Majorana, Ciohorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum*, and *Datura*.

For regeneration of transgenic plants from transgenic protoplasts, a suspension of transformed protoplasts or a petri plate containing transformed explants is first provided. Callus tissue is formed and shoots may be induced from callus and subsequently rooted. Alternatively, somatic embryo formation can be induced in the callus tissue. These somatic embryos germinate as natural embryos to form plants. The culture media will generally contain various amino acids and plant hormones, such as auxin and cytokinins. It is also advantageous to add glutamic acid and proline to the medium, especially for such species as corn and alfalfa. Efficient regeneration will depend on the medium, on the genotype, and on the history of the culture. These three variables may be empirically controlled to result in reproducible regeneration.

Plants may also be regenerated from cultured cells or tissues. Dicotyledonous plants which have been shown capable of regeneration from transformed individual cells to obtain transgenic whole plants include, for example, apple (*Malus pumila*), blackberry (*Rubus*), Blackberry/raspberry hybrid (*Rubus*), red raspberry (*Rubus*), carrot (*Daucus carota*), cauliflower (*Brassica oleracea*), celery (*Apium graveolens*), cucumber. (*Cucumis sativus*), eggplant (*Solanum melongena*), lettuce (*Lactuca sativa*), potato (*Solanum tuberosum*), rape (*Brassica napus*), wild soybean (*Glycine canescens*), strawberry (*Fragaria×ananassa*), tomato (*Lycopersicon esculentum*), walnut (*Juglans regia*), melon (*Cucumis melo*), grape (*Vitis vinifera*), and mango (*Mangifera indica*). Monocotyledonous plants which have been shown capable of regeneration from transformed individual cells to obtain transgenic whole plants include, for example, rice (*Oryza sativa*), rye (*Secale cereale*), and maize.

In addition, regeneration of whole plants from cells (not necessarily transformed) has also been observed in: apricot (*Prunus armeniaca*), asparagus (*Asparagus officinalis*), banana (hybrid *Musa*), bean (*Phaseolus vulgaris*), cherry (hybrid *Prunus*), grape (*Vitis vinifera*), mango (*Mangifera indica*), melon (*Cucumis melo*), ochra (*Abelmoschus esculentus*), onion (hybrid *Allium*), orange (*Citrus sinensis*), papaya (*Carrica papaya*), peach (*Prunus persica*), plum (*Prunus domestica*), pear (*Pyrus communis*), pineapple (*Ananas comosus*), watermelon (*Citrullus vulgaris*), and wheat (*Triticum aestivum*).

The regenerated plants are transferred to standard soil conditions and cultivated in a conventional manner. After the expression vector is stably incorporated into regenerated transgenic plants, it can be transferred to other plants by vegetative propagation or by sexual crossing. For example, in vegetatively propagated crops, the mature transgenic plants are propagated by the taking of cuttings or by tissue culture techniques to produce multiple identical plants. In seed propagated crops, the mature transgenic plants are self crossed to produce a homozygous inbred plant which is capable of passing the transgene to its progeny by Mendelian inheritance. The inbred plant produces seed containing the nucleic acid sequence of interest. These seeds can be grown to produce plants that would produce the desired polypeptides. The inbred plants can also be used to develop new hybrids by crossing the inbred plant with another inbred plant to produce a hybrid.

It is not intended that the present invention be limited to only certain types of plants. Both monocotyledons and dicotyledons are contemplated. Monocotyledons include grasses, lilies, irises, orchids, cattails, palms, *Zea mays* (such as corn), rice barley, wheat and all grasses. Dicotyledons include almost all the familiar trees and shrubs (other than confers) and many of the herbs (non-woody plants).

Tomato cultures are one example of a recipient for repetitive HRGP modules to be hydroxylated and glycosylated. The cultures produce cell surface HRGPs in high yields easily eluted from the cell surface of intact cells and they possess the required posttranslational enzymes unique to plants—HRGP prolyl hydroxylases, hydroxyproline O-glycosyltransferases and other specific glycosyltransferases for building complex polysaccharide side chains. Other recipients for the invention's sequences include, but are not limited to, tobacco cultured cells and plants, e.g., tobacco BY 2 (bright yellow 2).

In short, the present expression strategy can be used in plants, such as intact monocots and dicots, gymnosperms, ferns, bryophytes, cell suspension cultures, and algae, etc., to express proteins from various organisms, such as humans and other mammals and/or vertebrates, invertebrates, plants, sponges, bacteria, fungi, algae, archebacteria, potentially any organism on this planet.

Utilities

Depending on the particular peptide/polypeptide/protein expressed, a variety of utilities for the product are contemplated. If the expressed product includes green fluorescent protein, for example, the product or cells containing the product can be used in fluorescent screening assays. If the product is biologically active, for example, the expressed product may be used as a receptor antagonist or agonist, and may be used in vitro and in vivo. In vitro utilities include, for example, use in screening assays. In vivo utilities include, but are not limited to, use of the compounds for treatment of humans or other animals, based on the agonist or antagonist activities.

The term "treatment" as used herein with reference to a disease is used broadly and is not limited to a method of curing the disease. The term "treatment" includes any method that serves to reduce one or more of the pathological effects or symptoms of a disease or to reduce the rate of progression of one or more of such pathological effects or symptoms.

While space limits a description of all of the utilities for all of the peptides/polypeptides/proteins that can be made in accordance with this invention, examples will be specifically described with reference to growth hormone. The administration of the growth hormone described herein can be used for: treating growth hormone deficient humans or other animals, including dogs, cats, pigs, cows, horses; reducing catabolic side effects of glucocorticoids; treating osteoporosis; stimulating the immune system; accelerating wound healing; accelerating bone fracture repair; treating growth retardation; treating congestive heart failure; treating acute or chronic renal failure or insufficiency; treating physiological short stature, including growth hormone deficient children; treating short stature associated with chronic illness; treating obesity; treating growth retardation associated with Prader-Willi syndrome and Turner's syndrome; treating Metabolic syndrome (also known as Syndrome X); accelerating recovery and reducing hospitalization of burn patients or following major surgery; treating intrauterine growth retardation, skeletal dysplasia, hypercortisonism and Cushings syndrome; replacing growth hormone in stressed patients; treating osteochondrodysplasias, Noonans syndrome, sleep disorders, Alzheimer's disease, delayed wound healing, and psychosocial deprivation; treating pulmonary dysfunction and ventilator dependency; attenuating protein catabolic response after a major operation; treating malabsorption syndromes, reducing cachexia and protein loss due to chronic illness such as cancer or AIDS; accelerating weight gain and protein accretion in patients on total parenteral nutrition; treating hyperinsulinemia including nesidioblastosis; adjuvant treatment for ovulation induction and to prevent and treat gastric and duodenal ulcers; stimulating thymic development and preventing age-related decline of thymic function; adjunctive therapy for patients on chronic hemodialysis; treating immunosuppressed patients and enhancing antibody response following vaccination; improving muscle strength, increasing muscle mass, mobility, maintenance of skin thickness, metabolic homeostasis, renal homeostasis in the frail elderly; stimulating osteoblasts, bone remodeling, and cartilage growth; treating neurological diseases such as peripheral and drug induced neuropathy, Guillian-Barre Syndrome, amyotrophic lateral sclerosis, multiple sclerosis, cerebrovascular accidents and demyelinating diseases; and stimulating wool growth in sheep.

In farm animals, growth hormone can be used for increasing meat production in, for example, chickens, turkeys, sheep, pigs, and cattle; stimulation of pre- and post-natal growth, enhanced feed efficiency in animals raised for meat production, improved carcass quality (increased muscle to fat ratio); increased milk production in dairy cattle or in other mammalian species; improved body composition; modification of other GH-dependent metabolic and immunologic functions such as enhancing antibody response following vaccination or improved developmental processes; and accelerate growth and improve the protein-to-fat ratio in fish.

In companion animals, uses of growth hormone includes stimulating thymic development and preventing age-related decline of thymic function; preventing age-related decline of thymic function; preventing age-related decline in cognition; accelerating wound healing; accelerating bone fracture repair; stimulating osteoblasts, bone remodeling and cartilage growth; attenuating protein catabolic response after major surgery, accelerating recovery from burn injuries and major surgeries such as gastrointestinal surgery; stimulating the immune system and enhancing antibody response following vaccination; treating congestive heart failure, treating acute or chronic renal failure or insufficiency, treating obesity; treating growth retardation, skeletal dysplasia and osteochondrodysplasias; preventing catabolic side effects of glucocorticoids; treating Cushing's syndrome; treating malabsorption syndromes, reducing cachexia and protein loss due to chronic illness such as cancer; accelerating weight gain and protein accretion in animals receiving total parenteral nutrition; providing adjuvant treatment for ovulation induction and to prevent gastrointestinal ulcers; improving muscle mass, strength and mobility; maintenance of skin thickness, and improving vital organ function and metabolic homeostasis or in promoting growth of small animals to larger animals.

With regard to growth hormone antagonists described herein, diseases that may be treated are characterized by one or more of the following criteria: elevated levels of growth hormone production, elevated levels of growth hormone receptor production, and elevated cellular response of receptors to growth hormone. The term "elevated" as used herein is used with respect to the normal levels of growth hormone production, growth hormone receptor production, or growth hormone-mediated cellular response in a tissue (or tissues) of a diseased person (or animal) as compared to level in a normal individual. Diseases that may be treated with growth hormone antagonists by the methods of the invention include, but are not limited to, acromegaly, gigantism, cancer, diabetes, vascular eye diseases (diabetic retinopathy, retinopathy of prematurity, age-related macular degeneration, retinopathy of sickle-cell anemia, etc.) as well as nephropathy and glomerulosclerosis and in critically ill individuals in intensive care unit of a hospital.

Cancers that may be treated by the invention include, but are not limited to, cancers comprising tumor cells that express growth hormone receptors. Cancers that maybe treated by the methods of the invention include, but are not limited to: cardiac: sarcoma (angiosarcoma, fibrosarcoma, rhabdomyosarcoma, lipo sarcoma), myxoma, rhabdomyoma, fibroma, lipoma and teratoma; lung: bronchogenic carcinoma (squamous cell, undifferentiated small cell, undifferentiated large cell, adenocarcinoma), alveolar (bronchiolar) carcinoma, bronchial adenoma, sarcoma, lymphoma, chondromatous hamartoma, mesothelioma; gastrointestinal: esophagus (squamous cell carcinoma, adenocarcinoma, leiomyosarcoma, lymphoma), stomach (carcinoma, lymphoma, leiomyosarcoma), pancreas (ductal adenocarcinoma, insulinoma, glucagonoma, gastrinoma, carcinoid tumors, vipoma), small bowel (adenocarcinoma, lymphoma, carcinoid tumors, Kaposi's sarcoma, leiomyoma, hemangioma, lipoma, neurofibroma, fibroma), large bowel (adenocarcinoma, tubular adenoma, villous adenoma, hamartoma, leiomyoma); genitourinary tract: kidney (adenocarcinoma, Wilm's tumor (nephroblastoma), lymphoma, leukemia), bladder and urethra (squamous cell carcinoma, transitional cell carcinoma, adenocarcinoma), prostate (adenocarcinoma, sarcoma), testis (seminoma, teratoma, embryonal carcinoma, teratocarcinoma, choriocarcinoma, sarcoma, interstitial cell carcinoma, fibroma, fibroadenoma, adenomatoid tumors, lipoma); liver: hepatoma (hepatocellular carcinoma), cholangiocarcinoma, hepatoblastom, angiosarcoma, hepatocellular adenoma, hemangioma; bone: osteogenic sarcoma (osteosarcoma), fibrosarcoma, malignant fibrous histiocytoma, chondrosarcoma, Ewing's sarcoma, malignant lymphoma (reticulum cell sarcoma), multiple myeloma, malignant giant cell tumor, chordoma, osteochronfroma (osteocartilaginous exostoses), benign chondroma, chondroblastoma, choridromyxofibroma, osteoid osteoma and giant cell tumors; nervous system: skull (osteoma, hemangioma, granuloma, xanthoma, osteitis deformans), meninges (meningioma, meningiosarcoma, gliomatosis), brain (astrocytoma, medulloblastoma, glioma, ependymoma, germinoma [pinealoma], glioblastoma multiforme, oligodendroglioma, schwannoma, retinoblastoma, congenital tumors), spinal cord (neurofibroma, meningioma, glioma, sarcoma); gynecological: uterus (endometrial carcinoma), cervix (cervical carcinoma, pre-tumor cervical dysplasia), ovaries (ovarian carcinoma [serous cystadenocarcinoma, mucinous cystadenocarcinoma, endometrioid tumors, celioblastoma, clear cell carcinoma, unclassified carcinoma], granulosa-thecal cell tumors, Sertoli-Leydig cell tumors, dysgerminoma, malignant teratoma), vulva (squamous cell carcinoma, intraepithelial carcinoma, adenocarcinoma, fibrosarcoma, melanoma), vagina (clear cell carcinoma, squamous cell carcinoma, botryoid sarcoma (embryonal rhabdomyosarcoma), fallopian tubes (carcinoma); hematologic: blood (myeloid leukemia (acute and chronic), acute lymphoblastic leukemia, chronic lymphocytic leukemia, myeloproliferative diseases, multiple-myeloma, myelodysplastic syndrome), Hodgkin's disease, non-Hodgkin's lymphoma [malignant lymphoma]; skin: malignant melanoma, basal cell carcinoma, squamous cell carcinoma, Kaposi's sarcoma, moles, dysplastic nevi, lipoma, angioma, dermatofibroma, keloids, psoriasis; and adrenal glands: neuroblastoma. Specifically contemplated are uses in breast, colon, and prostate cancers, as well as leukemias and lymphomas.

The growth hormone agonist or antagonist may be combined with compatible, nontoxic pharmaceutical excipients and administered. In the case of administration to nonhuman animals, it may be preferable to incorporate the drug into the animal's feed, possibly in a prepared combination of drug and nutritional material ready for use by a farmer. Growth hormone or growth hormone antagonists may be administered orally, rectally, transdermally, by pulmonary infiltration, insufflation, or parenterally (including intravenously, subcutaneously and intramuscularly) to humans, in any suitable pharmaceutical dosage form. Polyethylene glycol moieties can also be added to growth hormone or growth hormone antagonists. In the case of treatment of retinopathy, it may be administered directly onto or into the eye by means of a conventional ocular pharmaceutical form.

An effective dosage and treatment protocol may be determined by conventional means, starting with a low dose in laboratory animals and then increasing the dosage while monitoring the effects, and systematically varying the dosage regimen as well. Generally, a clinical end point for GH action is measuring the level of serum IGF-1. As GH goes up, so does IGF-1. As GH goes down, so does IGF-1. So in conditions of GH deficiency, both GH and IGF-1 are low. When one give recombinant GH to these individuals, IGF-1 levels will rise. The clinician will attempt to keep IGF-1 level in age adjusted normal ranges. On the other hand, if one has too much GH, then IGF-1 will be high. When one gives the GH antagonist, IGF-1 levels will fall. The clinician will try to dose the patient such that the IGF-1 level will return to normal, age-adjusted levels. Numerous factors may be taken into consideration by a clinician when determining an optimal dosage for a given subject. Primary among these is the amount of growth hormone normally secreted by the pituitary, which is on the order of 0.5 mg/day for healthy adult humans. Additional factors include the size of the patient, the age of the patient, the general condition of the patient, the particular disease being treated, the severity of the disease, the presence of other drugs in the patient, the in vivo activity of the agonist or antagonist, and the like. The trial dosages would be chosen after consideration of the results of animal studies and the clinical literature with respect to administration of growth hormones, and/or of somatostatin (a growth hormone release inhibitor). It will be appreciated by the person of ordinary skill in the art that information such as binding constants and Ki derived from in vitro growth hormone binding competition assays may also be used in calculating dosages.

A typical human dose of a growth hormone antagonist would be from about 0.1 mg/day to about 10 mg/day, or from about 0.5 mg/day to about 2 mg/day, or about 1 mg/day. A typical human dose of a growth hormone agonist would be from about 10 mg/day to about 80 mg/day, or from about 20 mg/day to about 40 mg/day, or about 30 mg/day. As noted above, the appropriate dose can be determined empirically, by monitoring the IGF-1 level. For example, one gives enough GH antagonist to return IGF-1 levels to normal.

It should be noted that the glycosylation of proteins according to the invention can increase the molecular weight significantly. Growth hormone (22 kDa) modified with (Ser-Hyp)$_{10}$ (SEQ ID NO: 4), for example, exhibits a molecular weight of over 45 kDa. Thus, the molecular weight can more than double—yet activity remain the same. This should be taken into account when determining dose and dose equivalence should be considered on a molar basis.

The invention also provides pharmaceutical formulations for use in the subject methods of treating disease. The formulations can comprise at least one biologically active protein, such as, for example, growth hormone agonist or antagonist, and can include a pharmaceutically acceptable carrier. A variety of aqueous carriers may be used, e.g., water, buffered water, 0.4% saline, 0.3% glycine, and the like. The pharmaceutical formulations may also comprise additional components that serve to-extend the shelf-life of pharmaceutical formulations, including preservatives, protein stabilizers, and the like. The formulations are preferably sterile and free of particulate matter (for injectable forms). These compositions may be sterilized by conventional, well-known sterilization techniques. The compositions may contain pharmaceutically acceptable auxiliary substances as required to approximate physiological conditions such as pH adjusting and buffering agents, toxicity adjusting agents and the like, e.g., sodium acetate, sodium chloride, potassium chloride, calcium chloride, sodium lactate, etc. The formulations of the invention may be adapted for various forms of administration, including intramuscularly, subcutaneously, intravenously, intraocularly, and the like. The subject formulations may also be formulated so as to provide for the sustained release of growth hormone agonist or antagonist. Additional details for methods for preparing parenterally administrable compositions and adjustments necessary for administration to subjects are described in more detail in, for example, Remington's Pharmaceutical Science, which is incorporated herein by reference.

Other utilities will be readily apparent to those of skill in the art from reading this description.

EXAMPLES

Example 1

Expression of Gum Arabic Glycoprotein Analogs with Transgenic Tobacco Cells

Gum arabic glycoprotein (GAGP), an arabinoglactan protein (AGP), is the surface-active component accounting for gum arabic's emulsification properties. This functional GAGP is a typical HRGP that consists of four main carbohydrate moieties including galactose, arabinose, rhamnose and glucuronic acid, and a small proportion (~10%, w/w) of Hyp-rich protein as an integral part of the structure (Islam A. M., Phillips G. O., Sljivo A., Snowden M. J. and William P. A. (1997), Food Hydrocolloids 11(4):493-505.). The GAGP has already been isolated and well characterized. However, the gene encoding GAGP has not yet been cloned so far, nor has been the elucidation of the precise mechanism by which GAGP exhibits emulsifying ability and unique properties. Recently, the dominant amino acid sequence of GAGP polypeptide backbone was derived. It contains a repetitive 19-residue consensus motif SOOO(O/T/S)LSOSOTOTOO(O/L)GPH (SEQ ID NO: 114) (O: hydroxyproline) (Goodrum L. J., Patel A., Leykam J. F. and Kieliszewski M. J. (2000), Phytochem 54(1): 99-106). This provides the possibility to express GAGP analogs in transgenic plant cells by use of the synthetic gene technology. The genes encoding seven GAGP analogs were designed and constructed. They include three types: a) $[Gum]_3$, $[Gum]_8$ and $[Gum]_{20}$ are the genes that encoded three, eight, and twenty repeats of GAGP consensus motif, respectively; b) $[HP]_4$ and $[HP]_8$, which are the genes encoding four and eight repeats of the GAGP hydrophobic peptide [HP] that was also derived from the GAGP backbone polypeptide; and c) $[Gum]_8[HP]_2$ and $[Gum]_8[HP]_4$ are those of the combination of $[Gum]_8$ with two and four repeats of [HP]. These synthetic analogs were expressed as fusion proteins with enhanced green fluorescence protein (EGFP) in tobacco cells.

Materials and Methods

Gene Construction

All the gene cassettes constructed to express the GAGP analogs have a "$SS^{tob}$-[Synthetic gene]-EGFP" structure, in which the synthetic gene encoding various GAGP analogs was inserted between $SS^{tob}$, which encodes the extensin signal sequence from tobacco (De Loose, M., Gheysen, G., Tire, C., Gielen, J., Villarroel, R., Genetello, C., Van Montagu, M., Depicker, A. and Inze, D. (1991), *Gene*, 99: 95-100), and the gene for EGFP.

1) [Gum]$_3$, [Gum]$_8$ and [Gum]$_{20}$ Gene Synthesis

The [Gum]$_3$ gene encoding three repeats of SPSPTPTAP-PGPHSPPPTL (SEQ ID NO: 115) was constructed by head-to-tail polymerization of three sets of partially overlapping, complementary oligonucleotide pairs including 5'-linker, internal GAGP repeat and 3'-linker as described by Shpak et al (Shpak, E., Leykam, J. F., and Kieliszewski, M. J. (1999), *Proceedings of the National Academy of Sciences* (USA), 96: 14736-14741).

The [Gum]$_8$ and [Gum]$_{20}$ were designed to encode 4 and 10 repeats of GPHSPPPPLSPSPTPSPPL-GPHSPPPTL-SPSPTPTPPP (SEQ ID NO: 116), which was designated [Gum]$_2$. It has slight differences in alternating repeats, thus more closely resembles the native GAGP. The [Gum]$_Z$ gene was synthesized by primer extension of two mutually priming oligonucleotides (FIG. 1*a*) (Integrated DNA Technologies, Inc. Coralville, Iowa). The duplex was placed into pUC18 plasmid as a HindIII/EcoRI fragment. The construction of four and ten repeats of the synthetic gene involved annealing compatible but non-regenerable restriction sites (XmaI and BsrFI) of [Gum]$_Z$ fragment to generate double number of repeats (Lewis R. V., Hinman M., Kothakota S, and Fournier M. (1996), Protein Expression Purif 7:400-406). By reiteration, such a gene fragment could be geometrically multiplied to four and ten repeats in length.

2) [HP]$_2$, [HP]$_4$ and [HP]$_8$ Gene Synthesis

The [HP]$_2$, [HP]$_4$ and [HP]$_8$ genes were designed to encode two, four and eight repeats of TPLPTLTPLPAPTPPLLPH (SEQ ID NO: 117), as designated [HP]$_1$. [HP]$_1$ was also synthesized by primer extension of two mutually priming oligonucleotides (FIG. 1*b*) as above. The duplex was placed into pUC18 plasmid as a HindIII/EcoRI fragment. The construction of two ([HP]$_2$), four ([HP]$_4$) and eight ([HP]$_8$) repeats of the synthetic gene involved annealing compatible but non-regenerable restriction sites (BspEI and XmaI) of [HP]$_1$ fragment as described above.

3) pUC-SS$^{tob}$-[Gum]$_n$-EGFP (n=3, 8, 10) Plasmid Construction

The plasmid pUC-SS$^{tob}$-[Gum]$_3$-EGFP was constructed according to Shpak et al. (Shpak, E., Leykam, J. F., and Kieliszewski, M. J. (1999), *Proceedings of the National Academy of Sciences* (USA), 96: 14736-14741) (FIG. 2*a*). The polymerized [Gum]$_8$ and [Gum]$_{20}$ gene were subcloned into pUC-SS$^{tob}$-EGFP (Shpak, E., Leykam, J. F., and Kieliszewski, M. J. (1999), *Proceedings of the National Academy of Sciences* (USA), 96: 14736-14741) as a BspEI/AgeI fragment between SS$^{tob}$ and EGFP gene to generate the plasmid designated pUC-SS$^{tob}$-[Gum]$_8$-EGFP and pUC-SS$^{tob}$-[Gum]$_{20}$-EGFP (FIG. 2*b*).

4) pUC-SS$^{tob}$-[HP]$_n$-EGFP (n=4, 8) Plasmid Construction

The polymerized [HP]$_4$ and [HP]$_8$ genes were subcloned into pUC-SS$^{tob}$-EGFP (Shpak, E., Leykam, J. F., and Kieliszewski, M. J. (1999), *Proceedings of the National Academy of Sciences* (USA), 96: 14736-14741) as a AgeI/NcoI fragment between SS$^{tob}$ and EGFP gene to generate the plasmid designated pUC-SS$^{tob}$-[HP]$_4$-GFP and pUC-SS$^{tob}$-[HP]$_8$-EGFP (FIG. 3).

5) pUC-SS$^{tob}$-[Gum]$_8$[HP]$_n$-EGFP (n=2, 4) Plasmid Construction

The polymerized [HP]$_2$ and [HP]$_4$ gene were subcloned into pUC-SS$^{tob}$-[Gum]$_8$-EGFP as a AgeI/NcoI fragment between [Gum]$_8$ and EGFP gene to generate the plasmid designated pUC-SS$^{tob}$ [Gum]$_8$ [HP]$_2$-EGFP and pUC-SS$^{tob}$-[Gum]$_8$ [HP]$_4$-EGFP (FIG. 4).

The DNA sequencing of all the genes constructed above was performed in Department of Environmental and Plant Biology, Ohio University.

Plant Transformation Vector Construction

The entire "SS$^{tob}$-[Synthetic gene]-EGFP" construct was then sub-cloned into plant vector pBI121 (Clontech, CA) as a BamHI/SacI fragment in place of the β-glucuronidase reporter gene to generate plasmids pBI-SS$^{tob}$-[Synthetic gene]-EGFP. The expression of these synthetic genes was under the control of the 35S cauliflower mosaic virus (CaMV) promoter.

Plant Cell Transformation and Selection

Plasmid pBI121-SS$^{tob}$-[Synthetic gene]-EGFP was introduced into *Agrobacterium tumefaciens* strain LBA4404 by the freeze-thaw method (Holsters et al., 1978), then suspension-cultured tobacco cells (*Nicotiana tabacum*, BY2) were transformed with the *Agrobacterium* as described earlier (An, G. (1985), *Plant Physiol*, 79:568-570) and selected on solid Schenk & Hildebrandt (SH) medium (Schenk and Hildebrandt, 1972) containing 0.4 mg/L 2,4-dichlorophenoxyacetic acid (2,4-D), 200 mg/L kanamycin (Sigma) and 400 mg/L timentin (SmithKline Beecham, Pa.). At least ten cell lines of each construct were chosen and transferred into liquid SH medium comprised of the same components as above, except excluding timentin. After 10 days of culture at room temperature on an Innova gyrotary shaker (New Brunswick Scientific, Edison, N.J.) rotating at 90 rpm, the culture medium of each cell line was screened for target protein expression by determining the green fluorescence intensity. The cell lines producing the highest green fluorescence intensity of each construct were selected for subcultures.

Isolation of GAGP Analog-EGFP Fusion Glycoprotein from Medium

The culture medium, harvested after 12-14 days of culture, was concentrated about 10-fold by rotorevaporation under 30° C. An aliquot of 100-200 ml of medium containing 2 M sodium chloride was loaded onto a hydrophobic-interaction chromatography (HIC) column (Phenyl-Sepharose 6 Fast Flow, 16×700 mm, Amersham Pharmacia Biotech, Piscataway, N.J.) equilibrated in 2 M sodium chloride, and eluted with step-wise sodium chloride gradient from 2M, 1M to distilled water. The green fluorescent fraction eluted in distilled water was pooled, concentrated by freeze-drying, and then fractionated with a SUPEROSE-12 gel permeation chromatography (GPC) column (16×700 mm, Amersham Pharmacia Biotech) equilibrated in 200 mM sodium phosphate buffer (pH 7). The fluorescent fraction collected from the GPC column was further purified with HPLC by injecting into a Hamilton PRP-1 semi-preparative column (10 µm, 7×305 mm, Hamilton Co., Reno, Nev.) equilibrated with starting buffer A (0.1% trifluoroacetic acid). Proteins were eluted with buffer B (0.1% trifluoroacetic acid+80% acetonitrile, v/v) with a linear gradient of 0-70% B in 100 min at a flow rate of 1.0 ml/min.

Removal of EGFP from Fusion Glycoprotein by Tryptic Digestion

About 100 mg of fusion glycoprotein was heat-denatured in boiling water for 2 min, cooled, then combined with an equal volume of freshly prepared 2% (w/v) ammonium bicarbonate containing 10 mM calcium chloride and 100 µg trypsin. After overnight incubation at room temperature, the sample was fractionated with SUPEROSE-12 GPC column and further purified with HPLC using the same method as described above.

Emulsification Properties Characterization

Emulsion assays were carried out according to the method of Pearce and Kinsella (Pearce K. N. and Kinsella J. E. (1978), J Agric Food Chem 26(3):716-723) with some modifications. An emulsion was prepared by sonicating 0.4 mL of orange oil and 0.6 mL of 0.5% (w/v) protein solution (in 0.05M phosphate buffer, pH 6.5) in a glass tube with a Sonic Dismembrator (Fisher Scientific) equipped with a Microtip® probe. The amplitude was set at 4 and the oil/water mixture was treated for 60 s and kept on ice the whole time. A 100-μl aliquot of the emulsion thus obtained was then diluted serially with 0.1% SDS (sodium dodecyl sulfate) solution to give a final dilution of 1/1500. The optical density of the 1/1500 dilution was then determined at 500 nm, which was defined as emulsifying ability (EA). The remaining emulsion was stored vertically in the glass tube for 2 hr at room temperature, and then the optical density of the 1/1500 dilution was measured again. The percentage optical density remaining after 2 hr of storage is defined as emulsifying stability (ES).

Results

All of the GAGP analogs expressed by tobacco cells exhibited lower emulsifying ability than the native GAGP. The order of emulsifying ability of these GAGP analogs was $[HP]_8 > [HP]_4 > [Gum]_8[HP]_4 > [Gum]_8[HP]_2 > [Gum]_{20} > [Gum]_8 > [Gum]_3$. However, as shown in Table 1, when the EGFP was attached to these synthetic GAGP analogs, all the fusion proteins exhibited better emulsifying ability than native GAGP.

TABLE 1

The emulsification properties of the recombinant GAGP Analogs

| Constructs | Emulsifying ability (EA) | Emulsifying stability (ES) |
| --- | --- | --- |
| $[Gum]_3$ | 0.035 | 0 |
| $[Gum]_8$ | 0.055 | 0 |
| $[Gum]_{20}$ | 0.145 | 7.5% |
| $[HP]_4$ | 0.523 | 44.2% |
| $[HP]_8$ | 0.589 | 53.1% |
| $[Gum]_8[HP]_2$ | 0.181 | 18.2% |
| $[Gum]_8[HP]_4$ | 0.356 | 64.5% |
| $[Gum]_3$-EGFP | 1.223 | 94.5% |
| $[Gum]_8$-EGFP | 1.034 | 91.7% |
| $[Gum]_{20}$-EGFP | 0.968 | 93.4% |
| $[HP]_4$-EGFP | 1.445 | 81.2% |
| $[HP]_8$-EGFP | 1.334 | 83.4% |
| $[Gum]_8[HP]_2$-EGFP | 0.954 | 90.8% |
| $[Gum]_8[HP]_4$-EGFP | 0.938 | 91.5% |
| Control GAGP | 0.784 | 93.7% |
| EGFP | 0.156 | 17.9% |

Example 2

Increased Yield by Glycosylation

Some transgenic proteins expressed in plant cells generally give very low yields, thus their expression in plant systems is expensive, inefficient, and impractical. The present invention includes new ways to increase the yields of transgenic proteins produced in plant cells by producing the transgenic proteins as fusion glycoproteins possessing at least one hydroxyproline-rich glycoprotein (HRGP) glycomodule. This example employs some of the techniques described in Example 1 above to create novel proteins with glycomodules. By including these glycomodules, the yield of protein expressed into the medium is increased.

Briefly, there are two general types of glycomodules: 1) arabinogalactan glycomodules comprising clustered non-contiguous hydroxyproline (Hyp) residues in which the Hyp residues are O-glycosylated with arabinogalactan adducts (for example, Xaa-Hyp-Xaa-Hyp-Xaa-Hyp repeats where Xaa is Ser or Ala, but can be other amino acids like Thr or Val (or Lys or Gly). For example [Ser-Hyp]$_n$ or [Ala-Hyp]$_n$); and 2) arabinosylation glycomodules comprising contiguous Hyp residues in which some or all of the Hyp residues are arabinosylated with chains of arabinooligosaccharides from about 1-5 residues long (for example, Xaa-Hyp-Hyp-Hyp-Hyp$_n$ (SEQ ID NO: 118) modules, where Xaa can be Ser or Ala or other amino acids, e.g., [Ser-Hyp-Hyp-Hyp-Hyp]$_n$ (SEQ ID NO: 119) or [Ser-Hyp-Hyp]$_n$).

Tailoring the Genes for Expression:

The transgenes can include a signal sequence for secretion through the endomembrane system. For example, tobacco extensin signal sequence: MASLFATFLVVLSLSLAQT-TRSA (SEQ ID NO: 120) (Shpak, E., Leykam, J. F., and Kieliszewski, M. J. (1999), *Proceedings of the National Academy of Sciences* (USA), 96: 14736-14741); Tomato LeAGP-1 signal sequence: MDRKFVFLVSILCIVVASVTG (SEQ ID NO: 121) (Li & Showalter, Li and Showalter, Plant Mol. Biol. (1996) November; 32(4):641-52; Zhao Z D, Tan L, Showalter A M, Lamport D T, Kieliszewski M J., Plant J. 2002 August; 31(4):431-44).

1) Gene Construction

For these examples, the gene cassettes were constructed to have following structures:

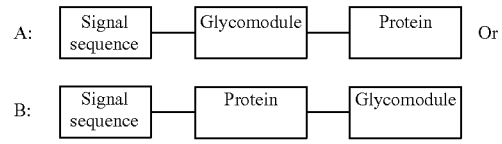

FIGS. 5, 6, 7, 8, and 9 show, respectively, schematics for the construction of gene cassettes for hGH-(SP)$_{10}$-EGFP ((SP)$_{10}$ disclosed as SEQ ID NO: 51), hGH-(SP)$_{10}$ ((SP)$_{10}$ disclosed as SEQ ID NO: 51), INF-(SP)$_{10}$ ((SP)$_{10}$ disclosed as SEQ ID NO: 51), HSA (human serum albumin)-(SP)$_{10}$ ((SP)$_{10}$ disclosed as SEQ ID NO: 51), and DomainI (domain I of HSA)-(SP)$_{10}$ ((SP)$_{10}$ disclosed as SEQ ID NO: 51). FIG. 10A shows the genetic construct for the expression of hGH-(SP)$_{10}$ ((SP)$_{10}$ disclosed as SEQ ID NO: 51), FIG. 10B shows how the construct was created by primer extension. FIGS. 11, 12 (A and B), 13, and 14, show, respectively, the genetic constructs for the expression of hGH-(SP)$_{10}$-EGFP ((SP)$_{10}$ disclosed as SEQ ID NO: 51), HSA-(SP)$_{10}$, DomainI(of HSA)-(SP)$_{10}$ ((SP)$_{10}$ disclosed as SEQ ID NO: 51), and INF2a(interferon 2α)-(SP)$_{10}$ ((SP)$_{10}$ disclosed as SEQ ID NO: 51).

Summary of Results

EGFP was expressed with an N-terminal signal sequence that targeted EGFP for secretion. However, even with the signal sequence attached, the average amounts secreted into the medium were so low that they could not be quantified accurately.

In contrast, when EGFP was expressed as HRGP fusion proteins of various types the yields increased dramatically. Tables 2 and 3 below give examples of different types of plants, proteins, and constructs that gave increased yield.

TABLE 2

Yield examples of purified HRGP-EGFP fusion glycoproteins expressed in tobacco BY2 cells (those also expressed in tomato or Arabidopsis are noted)

| Purified Fusion Glycoprotein | mg purified/L medium collected | |
|---|---|---|
| ARABINOGALACTAN GLYCOMODULE ADDED | | |
| (Ser-Hyp)$_{32}$-EGFP (SEQ ID NO: 122) | 23 | Shpak et al. (1999) |
| (Ala-Hyp)$_{51}$-EGFP (SEQ ID NO: 123) | 30 | Tan et al. (2003) |
| (Thr-Hyp)$_{99}$-EGFP (SEQ ID NO: 124) | 10 | Tan et al. (2003) |
| (Val-Hyp)$_{10}$-EGFP (SEQ ID NO: 125) | 6 | Tan et al. (2003) |
| ARABINOSYLATION GLYCOMODULE ADDED | | |
| (Ser-Hyp-Hyp)$_{24}$-EGFP (SEQ ID NO: 126) | 10 | Shpak et al. (2001) |
| (Ser-Hyp-Hyp-Hyp)$_{15}$-EGFP (SEQ ID NO: 127) | 36 | Shpak et al. (2001) |
| (Ser-Hyp-Hyp-Hyp-Hyp)$_{18}$-EGFP (SEQ ID NO: 128) | 23 | Shpak et al. (2001) |
| (YK)$_{20}$-EGFP$^a$ | 3-27 | Held et al 2004 Journal of Biological Chemistry Vol 279: 55474-55482 |
| (YK)$_{8}$-EGFP$^a$ | 4-7 | Held et al |
| (YL)$_{8}$-EGFP$^a$ | 6-23 | Held et al (2004) |
| (FK)$_{9}$-EGFP$^a$ | 0-3.3 | Held et al, (2004) |
| BOTH TYPES OF GLYCOMODULE ADDED | | |
| (Ala-Hyp)$_{4}$-(YK)$_{20}$-EGFP (SEQ ID NO: 129) | 111 | unpublished |
| (GAGP)$_{3}$-EGFP | 8 | Shpak et al (1999) |
| (Ala-Ala-Ser-Ser-Hyp-Hyp-Leu)$_{6}$-EGFP (SEQ ID NO: 130) and (Ala-Ala-Gly-Thr-Thr-Hyp-Hyp)$_{6}$-EGFP (SEQ ID NO: 131) (tobacco and tomato) | >50 | unpublished |
| EGFP-LeAGP-1ΔGPI (tobacco and Arabidopsis) | >50 | unpublished |

$^a$(YK)$_{20}$ and (YK)$_{8}$ designate the sequences: (Ser-Hyp$_4$-Ser-Hyp-Ser-Hyp$_4$-Tyr-Tyr-Tyr-Lys)$_{20}$ (SEQ ID NO: 132) and (Ser-Hyp$_4$-Ser-Hyp-Ser-Hyp$_4$-Tyr-Tyr-Tyr-Lys)$_{8}$ (SEQ ID NO: 133) respectively; (YL)$_{8}$ designates (Ser-Hyp$_4$-Ser-Hyp-Ser-Hyp$_4$-Tyr-Tyr-Tyr-Leu)$_{8}$ (SEQ ID NO: 134); (FK)$_{8}$ designates (Ser-Hyp$_4$-Ser-Hyp-Ser-Hyp$_4$-Phe-Phe-Phe-Lys)$_{8}$ (SEQ ID NO: 135).

TABLE 3

Yield of non-plant proteins expressed as a secreted protein in *Nicotiana tabacum* suspension cultured cells ((Ser-Hyp)$_{10}$ disclosed as SEQ ID NO: 4)

| HGH fusion protein | mg/L medium | |
|---|---|---|
| hGH-EGFP | None detected | unpublished |
| hGH-(Ser-Hyp)$_{10}$-EGFP | 16-24 | unpublished |
| hGH | None detected | unpublished |
| hGH-(Ser-Hyp)$_{10}$ | 20-32 mg | unpublished |
| INFα2 | None detected | unpublished |
| INFα2-(Ser-Hyp)$_{10}$ | + | unpublished |
| HSA | + | unpublished |
| HSA-(Ser-Hyp)$_{10}$ | + | unpublished |
| HSADomI | + | unpublished |
| HSADomI-(Ser-Hyp)$_{10}$ | + | unpublished |

Detailed Breakdown of Results

The results summarized above are taken from a number of different studies, with different constructs and different proteins expressed, and were selected as being representative of each particular study. The following section breaks down the process of expression, observed at various stages, focusing on the expression of a) an hGH construct without a glycosylation module, and b) an hGH construct having a glycosylation module. In some instances, the expression of hGH-(SO)$_{10}$ ((SO)$_{10}$ disclosed as SEQ ID NO: 4) was compared to hGH-(SO)$_{10}$-EGFP ((SO)$_{10}$ disclosed as SEQ ID NO: 4), to observe how different peptide elements were expressed.

Figure 15:
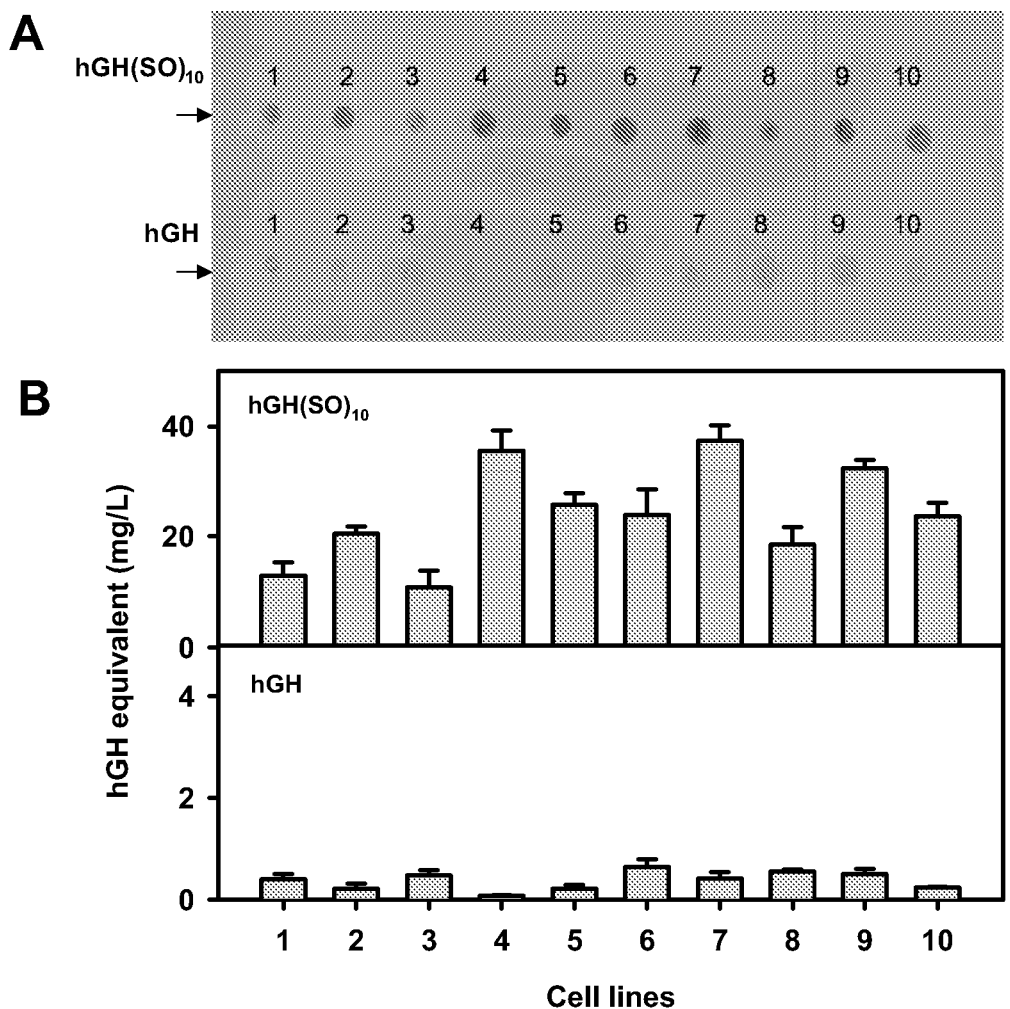
FIG. 15 shows the detection of hGH equivalents secreted into the medium of ten lines of tobacco cells transformed with either hGH-(SO)$_{10}$ ((SO)$_{10}$ disclosed as SEQ ID NO: 4) and hGH.

FIG. 15 shows detection of hGH equivalents secreted into the medium of tobacco cells transformed with hGH-(SO)$_{10}$ ((SO)$_{10}$ disclosed as SEQ ID NO: 4) and hGH. Frame (A) shows a dot blot assay of hGH equivalents occurring in one µL of medium from 10 cell lines transformed with either hGH-(SO)$_{10}$ ((SO)$_{10}$ disclosed as SEQ ID NO: 4) (upper) or hGH (lower) Frame (B) shows sandwich ELISA quantitation of the hGH equivalents in the medium from the same two sets of ten cell lines. These results demonstrate that attachment of a glycosylation module significantly increases the secretion of expressed protein into the medium.

Figure 16:
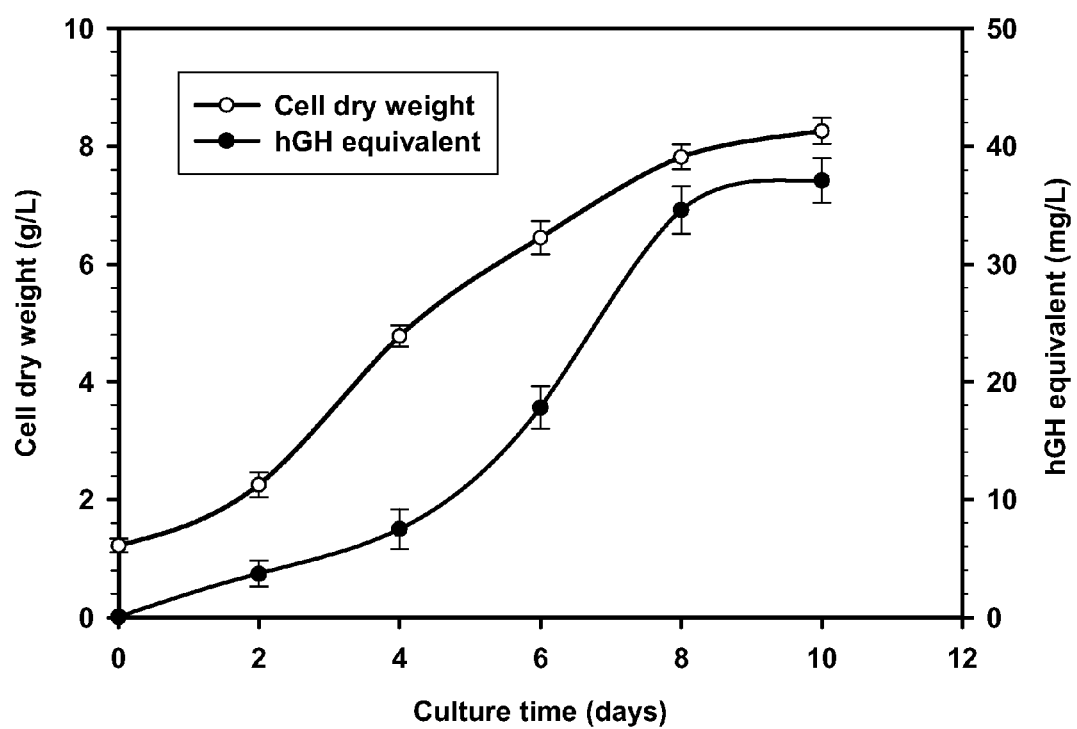
FIG. 16 shows the time course of cell growth and production of hGH equivalents in the culture medium of tobacco cells transformed with hGH-(SP)$_{10}$ ((SP)$_{10}$ disclosed as SEQ ID NO: 51).

FIG. 16 shows the time course of cell growth and hGH equivalents in BY-2 tobacco cells transformed with hGH-(SO$_{10}$ ((SO)$_{10}$ disclosed as SEQ ID NO: 4). The tobacco cells were grown in 250-mL Erlenmeyer flasks containing 100 mL medium. Three flasks were withdrawn at 2-day intervals to measure the cell dry weight and hGH equivalents in the medium. The cultured cells were harvested by filtration on a sintered funnel, and the filtrate (culture medium) collected for hGH assays; the cells were washed three times with distilled water, then lyophilized for three days before dry weight measurements. The hGH equivalents were measured via sandwich ELISA assays.

The medium from transformed cells was harvested after 8-10 days of culture by filtration on a coarse sintered funnel and supplemented with sodium chloride to a final concentration of 2 M. Insoluble material was pelleted by centrifugation at 25,000×G for 20 min at 4 C. The supernatant was fractionated by hydrophobic-interaction chromatography (HIC) on a Phenyl-Sepharose 6 column (Phenyl-Sepharose 6 Fast Flow, 16 by 700 mm, Amersham Pharmacia Biotech) equilibrated in 2 M sodium chloride. After the medium was completely loaded onto the HIC column, the proteins were eluted stepwise first with Tris buffer (25 mM, pH8.5)/2M sodium chloride, followed by Tris buffer (25 mM, pH8.5)/0.8M sodium chloride, and then the Tris buffer (25 mM, pH8.5)/0.2N sodium chloride. The flow rate was 1.0 ml/min, and the fractions were monitored at 220 nm with a UV detector. Each eluted fraction was assayed for the presence of hGH by dot blots and ELISA assays. The Tris buffer (25 mM, pH8.5)/

0.2N NaCl fraction containing most of the hGH-(SO)$_{10}$ fusion glycoprotein ((SO)$_{10}$ disclosed as SEQ ID NO: 4) was concentrated by ultrafiltration at 4° C., and either used for hGH binding and activity assays, or further purification by reversed phase chromatography.

Figure 18:
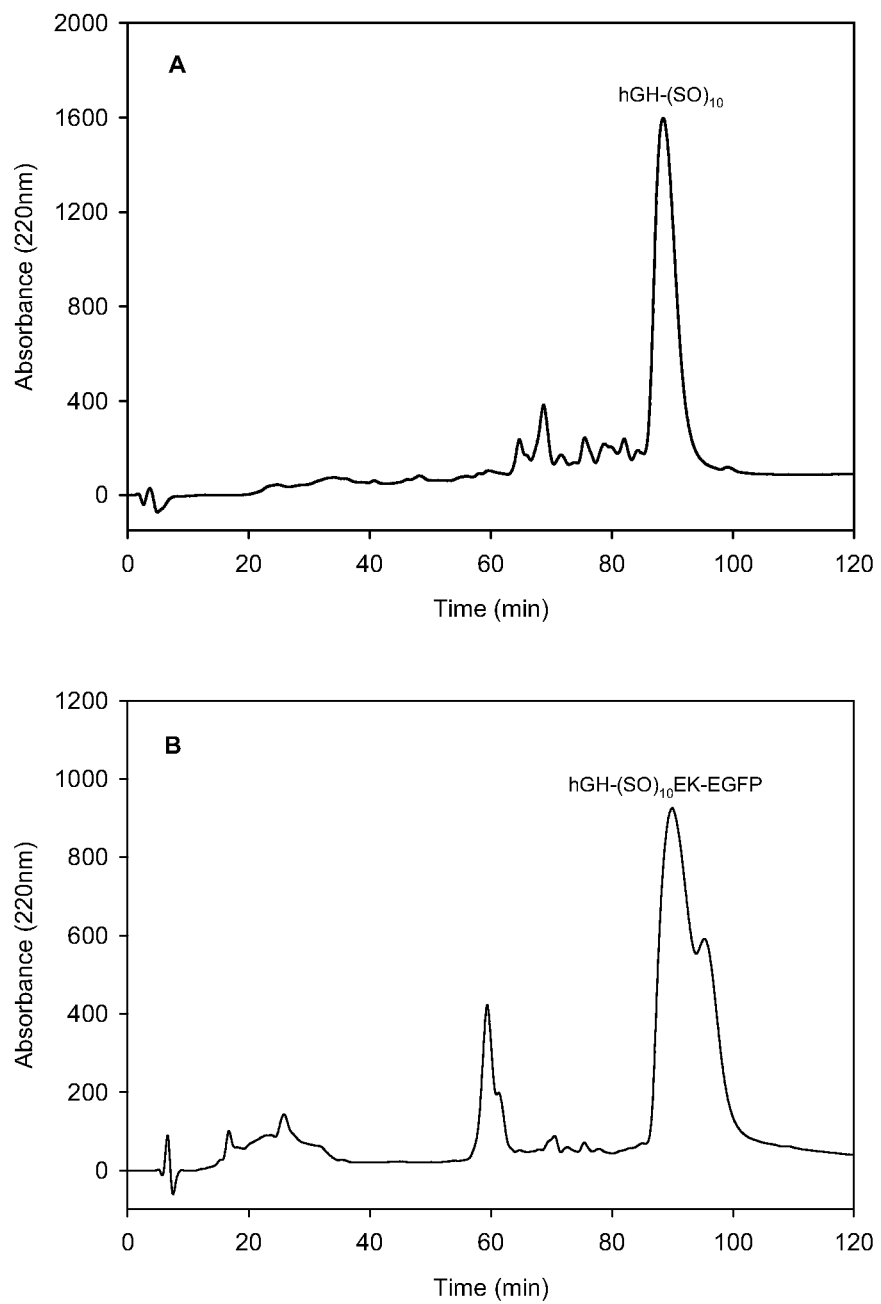
FIG. 18 shows chromatographic profiles for the isolation of hGH-(SO)$_{10}$ ((SO)$_{10}$ disclosed as SEQ ID NO: 4) and hGH-(SO)$_{10}$-EGFP ((SO)$_{10}$ disclosed as SEQ ID NO: 4) by reversed-phase HPLC.

FIG. 18 shows the isolation of hGH-(SO)$_{10}$ ((SO)$_{10}$ disclosed as SEQ ID NO: 4) (A) and hGH-(SO)$_{10}$-EGFP ((SO)$_{10}$ disclosed as SEQ ID NO: 4) (B) by reversed-phase chromatography on a Hamilton polymeric reversed phase-1 (PRP-1) column equilibrated with buffer A (0.1% trifluoroacetic acid). Proteins were eluted with buffer B (0.1% trifluoroacetic acid, 80% acetonitrile, v/v) using a two step linear gradient of 0-30% B in 15 min, followed by 30%-70% B in 90 min at a flow rate of 0.5 ml/min. Absorbance was measured at 220 nm. The fusion protein hGH-(SO)$_{10}$-EGFP ((SO)$_{10}$ disclosed as SEQ ID NO: 4) was first fractionated by gel permeation chromatography on a Superose-12 column before injection onto the PRP-1.

Figure 17:
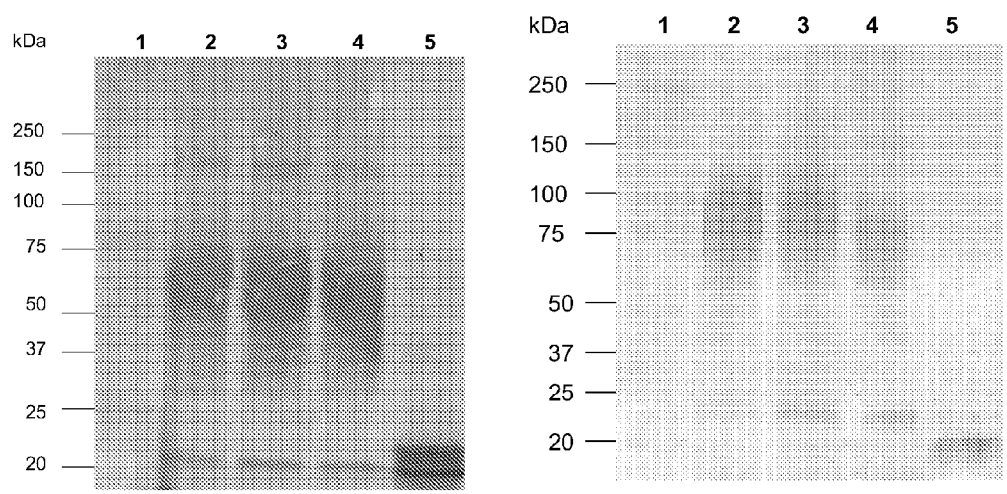
FIG. 17 shows Western blot detection of hGH-(SO)$_{10}$ ((SO)$_{10}$ disclosed as SEQ ID NO: 4) (left panel) and hGH-(SO)$_{10}$-EGFP ((SO)$_{10}$ disclosed as SEQ ID NO: 4) in culture medium.

FIG. 17 shows Western blot detection of hGH-(SO)$_{10}$ ((SO)$_{10}$ disclosed as SEQ ID NO: 4) (Left hand panel) and hGH-(SO)$_{10}$-EGFP ((SO)$_{10}$ disclosed as SEQ ID NO: 4) (Right hand panel) using anti-hGH antibodies. The gels were run after fractionation of the culture medium using hydrophobic interaction chromatography. Samples (10 μg protein) were run on a 4-15% SDS-PAGE, then transferred to a NitroBind membrane. Rabbit polyclonal anti-hGH antibody diluted at 1:500 in TTBS buffer (100 mM Tris-HCl, pH 7.5, 150 mM NaCl and 0.1% TWEEN 20, a polysorbate surfactant) and alkaline phosphatase-conjugated goat anti-rabbit IgG diluted at 1:1000 in TTBS buffer were used as primary and secondary antibodies, respectively. Lanes 1:molecular marker; Lanes 2, 3, 4: hGH-(SO)$_{10}$ ((SO)$_{10}$ disclosed as SEQ ID NO: 4) (A) or hGH-(SO)$_{10}$-EGFP ((SO)$_{10}$ disclosed as SEQ ID NO: 4) (B) culture medium; Lanes 5: hGH standard (2 μg).

The fuzzy bands at 50-75 kDa (A) or 75 to 100 kDa is typical for arabinogalactan-proteins, which includes hGH-(SO)$_{10}$ and hGH-(SO)$_{10}$-EGFP ((SO)$_{10}$ disclosed as SEQ ID NO: 4). Enough O-Hyp arabinogalactans were added to bring the molecular mass to ~50 kDa. Carbohydrate not only creates sites of microheterogeneity, but also interferes with SDS binding, which produces the fuzziness seen in the gel. The band at >150 kDa in (A) may be a contaminant. The band at ~22 kDa in (A) is probably hGH released from the hGH-(SO)$_{10}$ ((SO)$_{10}$ disclosed as SEQ ID NO: 4) fusion protein either during the isolation process or on heat treatment in the pH 8 loading buffer. We have observed that SOSO-rich constructs (SEQ ID NO: 136) (O=Hyp) are somewhat labile when heated in base (pH 8) perhaps due to an N->O acyl shift, which is an issue around Ser residues. Rather than heating the constructs before SDS PAGE, the proteins can be incubated at room temperature for several hours in the loading buffer (no heat), which appears to solve the problem. The band at ~25 kDa in (B) could be EGFP, hGH with some SO and glycan attached, or some contaminant.

The presence of an EGFP element did not significantly change the glycosylation profile of the expressed protein. As shown in Table 4 below, galactose and arabinose comprised the major monosaccharides in hGH(SO)$_{10}$ or hGH-(SO)$_{10}$-EGFP ((SO)$_{10}$ disclosed as SEQ ID NO: 4), with lesser amounts of rhamnose and uronic acid. The sugar accounted for 55.5% of the dry weight of hGH(SO)$_{10}$((SO)$_{10}$ disclosed as SEQ ID NO: 4), and 46.5% of the dry weight of hGH-(SO)$_{10}$-EGFP fusion glycoproteins ((SO)$_{10}$ disclosed as SEQ ID NO: 4).

TABLE 4

Glycosyl composition of hGH-(SO)$_{10}$ and hGH-(SO)$_{10}$-EGFP ((SO)$_{10}$ disclosed as SEQ ID NO: 4)

| Glycosyl residue | hGH-(SO)$_{10}$ | | hGH-(SO)$_{10}$-EGFP | |
|---|---|---|---|---|
| | Mol % | (weight % | Mol % | weight % |
| Rha | 7 | 3.9 | 8 | 3.7 |
| Ara | 32 | 15.2 | 28 | 11.0 |
| Gal | 43 | 25.1 | 49 | 24.2 |
| GlcUA | 18 | 11.3 | 14 | 7.6 |
| Total | 100 | 55.5 | 100 | 46.5 |

Table 5 shows the glycosylation profile of INF-(SO)$_{10}$ ((SO)$_{10}$ disclosed as SEQ ID NO: 4), which was similar to that of hGH-(SO)$_{10}$ ((SO)$_{10}$ disclosed as SEQ ID NO: 4).

TABLE 5

Glycosyl composition of INF-(SO)$_{10}$ ((SO)$_{10}$ disclosed as SEQ ID NO: 4)

| | INF-(SO)$_{10}$ | |
|---|---|---|
| Glycosyl residue[a] | Molar percentage (mol %) | Weight percentage (wt %) |
| Rha | 9 | 4.6 |
| Ara | 30 | 17.6 |
| Gal | 45 | 29.3 |
| Uronic acids | 16 | 12.3 |
| Total | 100 | 63.8 |

As predicted by the Hyp contiguity hypothesis (Shpak, E., Leykam, J. F., and Kieliszewski, M. J. (1999), *Proceedings of the National Academy of Sciences* (USA), 96: 14736-14741; Shpak, E., Barbar, E., Leykam, J. F. & Kieliszewski, M. J. *J. Biol. Chem.* 276, 11272-11278 (2001)), both hGH-(SO)$_{10}$ and hGH-(SO)$_{10}$-EGFP fusion glycoproteins ((SO)$_{10}$ disclosed as SEQ ID NO: 4) contained only Hyp-polysaccharide (Table 6). The same effect was observed in INF-(SO)$_{10}$ ((SO)$_{10}$ disclosed as SEQ ID NO: 4) (Table 7).

TABLE 6

| | Represented as percent of total hydroxyproline | | |
|---|---|---|---|
| Hyp glycoside | Predicted | hGH-(SO)$_{10}$ | hGH-(SO)$_{10}$-EGFP |
| Hyp-PS | 100 | 100 | 100 |
| Hyp-Ara4 | | 0 | 0 |
| Hyp-Ara3 | | 0 | 0 |
| Hyp-Ara2 | | 0 | 0 |
| Hyp-Ara1 | 0 | 0 | 0 |
| NG-Hyp | | Trace | Trace |

Hyp-PS, Hyp polysaccharide; Hyp-Ara$_n$, Hyp-arabinoside$_{1-4}$; NG-Hyp, non-glycosylated Hyp ((SO)$_{10}$ disclosed as SEQ ID NO: 4)

TABLE 7

Hydroxyproline glycoside profiles of INF-$(SO)_{10}$ ($(SO)10$ disclosed as SEQ ID NO: 4)

| Hyp glycoside | Molar percentage of total hydroxyproline | |
|---|---|---|
| | Predicted | INF-$(SO)_{10}$ |
| Hyp-PS | 100 | 100 |
| Hyp-Ara4 | | 0 |
| Hyp-Ara3 | | 0 |
| Hyp-Ara2 | 0 | 0 |
| Hyp-Ara1 | | 0 |
| NG-Hyp | | Trace |

Hyp-PS, Hyp polysaccharide; Hyp-$Ara_n$, Hyp-$arabinoside_{1-4}$; NG-Hyp, non-glycosylated Hyp Table 8 shows the glycosyl linkage analysis of hGH-$(SO)_{10}$ ($(SO)_{10}$ disclosed as SEQ ID NO: 4).

TABLE 8

| Glycosyl Linkage | Mole Percent |
|---|---|
| t-Rha (p) | 6 |
| t-Ara (f) | 17 |
| t-Ara (p) | 6 |
| 1,4-Ara (p) | 7 |
| 1,5-Ara (f) | 8 |
| 1,2,3,5-Ara (f) | 1 |
| t-Gal (p) | 4 |
| 1,3-Gal (p) | 10 |
| 1,6-Gal (p) | 5 |
| 1,3,4-Gal (p) | 1 |
| 1,3,6-Gal (p) | 17 |
| 1,3,4,6-Gal (p) | 1 |
| 1,2,3,4,6-Gal (p) | 1 |
| t-GlcA (p) | 2 |
| 1,4-Glc(p) | 10 |
| 1,4-GlcA (p) | 4 |
| Terminal residues | 35 |
| Branched residues | 65 |

General Cloning Description

The gene cassettes were built to encode the glycosylation site at either the N-terminus or C-terminus of the protein, and were sub-cloned into pUC18-$SS^{tob}$-EGFP (pUC18 vector encoding the tobacco extensin signal sequence [$SS^{tob}$] and EGFP). The genes were sequenced and then subcloned into pBI21 (Clontech) as BamHI/SacI fragments in place of the β-glucuronidase gene and behind the Cauliflower Mosaic Virus 35S promoter.

Plant Transformation

The pBI121-derived plasmids containing the gene cassettes were transferred into Agrobacterium tumefaciens strain LBA4404. The transformation of tobacco cells followed methods described earlier (An, G. (1985), Plant Physiol, 79:568-570; Shpak, E., Leykam, J. F., and Kieliszewski, M. J. (1999), Proceedings of the National Academy of Sciences (USA), 96: 14736-14741; Zhao Z D, Tan L, Showalter A M, Lamport D T, Kieliszewski M J., Plant J. 2002 August; 31(4): 431-44). The tomato cells were transformed with leaf disk method (McCormick et al, 1986 Leaf disc transformation of cultivated tomato (L. esculentum) using Agrobacterium tumefaciens McCormick, S.; Niedermeyer, J.; Fry, J.; Barnason, A.; Horsch, R.; Fraley, R. Plant Cell Reports 5: 81-84) The Arabidopsis cells were transformed using the method of Forreiter et al. (Forreiter C, Kirschner M, Nover L., Plant Cell. 1997 December; 9(12):2171-81).

Cell Cultures

All the transformed cells were cultured in SH medium (Schenk and Hildebrandt, 1972) containing 34 g/L sucrose, 0.4 mg/L 2,4-dichlorophenoxyacetic acid (2,4-D) and 200 mg/L kanamycin (Sigma). Flasks (250-ml or 1000-ml) were placed on gyratory shakers rotating at 90 rpm at room temperature. Media were collected after 10-20 days cultures for isolation of target proteins.

Glycoprotein Isolation

Glycoproteins were isolated from media using hydrophobic-interaction chromatography (HIC) and reversed-phase chromatography, as shown before (NOTE the following differences: 2 M NaCl/25 mM Tris pH 8.5 was used to equilibrate the HIC column; and the column was eluted with a stepwise gradient of a second buffer containing just 25 mM Tris pH 8.5. The hGH derivative eluted in the gradient at 25 mM Tris/0.2 M) (Shpak, E., Barbar, E., Leykam, J. F. & Kieliszewski, M. J. J. Biol. Chem. 276, 11272-11278 (2001); Zhao Z D, Tan L, Showalter A M, Lamport D T, Kieliszewski M J., Plant J. 2002 August; 31(4):431-44; Li L C, Bedinger P A, Volk C, Jones A D, Cosgrove D J, Plant Physiol. 2003 August; 132(4):2073-85).

Example 3

Examples of Additional Human Growth Hormone Constructs

In addition to the hGH constructs described in Example 2 above, the following constructs have also been synthesized and transformed into tobacco cells.

1. hGH-$(SO)_1$ $SS^{tob}$-hGH-(SP)/gene fragment was amplified with PCR using pUC-$SS^{tob}$-hGH-$(SP)_{10}$ ($(SP)_{10}$ disclosed as SEQ ID NO: 51) as template and the following primer set:

```
                                      (SEQ ID NO: 139)
5'-AGAGGATCCGCAATGGGAAAAATGGC-3'
and
                                      (SEQ ID NO: 138)
5'-TAAGTGTACAATCAGGGTGAGAAGCCGCAGCTG-3'
```

The resulting PCR fragment was then sub-cloned into pUC-$SS^{tob}$-EGFP as a BamHI/BsrGI fragment, replacing $SS^{tob}$-EGFP, to generate the plasmid designated pUC-$SS^{tob}$-hGH-$(SP)_1$ (FIG. 19).

2. hGH-$(SO)_2$ ($(SO)_2$ Disclosed as SEQ ID NO: 136)

$SS^{tob}$-hGH-$(SP)_2$($(SP)_2$ disclosed as SEQ ID NO: 90) gene fragment was amplified with PCR using pUC-$SS^{tob}$-hGH-$(SP)_{10}$ ($(SP)_{10}$ disclosed as SEQ ID NO: 51) as template and the following primer set:

```
                                      (SEQ ID NO: 139)
5'-AGAGGATCCGCAATGGGAAAAATGGC-3'
and
                                      (SEQ ID NO: 140)
5'-TAAGTGTACAATCATGGAGAGGGTGAGAAGCC-3'
```

The resulting PCR fragment was then sub-cloned into pUC-$SS^{tob}$-EGFP as a BamHI/BsrGI fragment, replacing $SS^{tob}$-EGFP, to generate the plasmid designated pUC-$SS^{tob}$-hGH-$(SP)_2$ ($(SP)_2$ disclosed as SEQ ID NO: 90) (FIG. 20).

3. hGH-$(SO)_5$ ($(SO)_5$ Disclosed as SEQ ID NO: 143)

$SS^{tob}$-hGH-$(SP)_5$($(SP)_5$ disclosed as SEQ ID NO: 92) gene fragment was amplified with PCR using pUC-$SS^{tob}$-hGH-$(SP)_{10}$ ($(SP)_{10}$ disclosed as SEQ ID NO: 51) as template and the following primer set:

```
                                          (SEQ ID NO: 139)
5'-AGAGGATCCGCAATGGGAAAAATGGC-3'
and
                                          (SEQ ID NO: 141)
5'-TAAGTGTACAATCAAGGCGATGGGGAAGGGCTTGG-3'
```

The resulting PCR fragment was then sub-cloned into pUC-SS$^{tob}$-EGFP as a BamHI/BsrGI fragment, replacing SS$^{tob}$-EGFP, to generate the plasmid designated pUC-SS$^{tob}$-hGH-(SP)$_5$ ((SP)$_5$ disclosed as SEQ ID NO: 92) (FIG. 21).

4. hGH-(SO)$_{20}$ ((SO)$_{20}$ Disclosed as SEQ ID NO: 144)

A NcoI restriction site was first introduced right after SS$^{tob}$-hGH-(SP)$_{10}$ gene fragment ((SP)$_{10}$ disclosed as SEQ ID NO: 51) with PCR using pUC-SS$^{tob}$-hGH-(SP)$_{10}$ ((SP)$_{10}$ disclosed as SEQ ID NO: 51) as template and the following primer set:

```
                                          (SEQ ID NO: 139)
5'-AGAGGATCCGCAATGGGAAAAATGGC-3'
and
                                          (SEQ ID NO: 142)
5'-ATAAGCCATGGTTGGGCTGGGAGAAGGGGATGG-3'
```

The resulting PCR fragment, SS$^{tob}$-hGH-(SP)$_{10}^{NcoI}$ ((SP)$_{10}$ disclosed as SEQ ID NO: 51) was then sub-cloned into pUC-SS$^{tob}$-hGH$^{NcoI}$-(SP)$_{10}$*((SP)$_{10}$ disclosed as SEQ ID NO: 51) as a BamHI/NcoI fragment, replacing SS$^{tob}$-hGH$^{NcoI}$, to generate the plasmid designated pUC-SS$^{tob}$-hGH-(SP)$_{20}$ ((SP)$_{20}$ disclosed as SEQ ID NO: 93) (FIG. 22). The extra nucleotides introduced into this plasmid for cloning purpose were then removed by site-directed mutagenesis using the QuickChange Mutagenesis kit (Strategies, CA). (*: pUC-SS$^{tob}$-hGH$^{NcoI}$-(SP)$_{10}$ ((SP)$_{10}$ disclosed as SEQ ID NO: 51) is the preliminary pUC-SS$^{tob}$-hGH-(SP)$_{10}$ plasmid ((SP)$_{10}$ disclosed as SEQ ID NO: 51) without subject to site-directed mutation to remove the NcoI restriction site.)

5. (SO)$_{10}$-hGH-(SO)$_{10}$ ((SO)$_{10}$ Disclosed as SEQ ID NO: 4)

A (SP)$_{10}$ fragment ((SP)$_{10}$ disclosed as SEQ ID NO: 51) was first amplified with PCR using pUC-SS$^{tob}$-hGH-(SP)$_{10}$ ((SP)$_{10}$ disclosed as SEQ ID NO: 51) as template and the following primer set:

```
                                          (SEQ ID NO: 145)
5'-TTATCCCGGGCCTCACCCTCTCCAAGCCCTTCC-3'
and
                                          (SEQ ID NO: 146)
5'-TTATCCCGGGTGGGCTGGGAGAAGGGGATGG-3'
```

The resulting PCR fragment, $^{XmaI}$(SP)$_{10}^{XmaI}$ ((SP)$_{10}$ disclosed as SEQ ID NO: 51) was sub-cloned into pUC-SS$^{tob}$-$^{XmaI}$hGH-(SP)$_{10}$((SP)$_{10}$ disclosed as SEQ ID NO: 51) at the XmaI site, inserting between SS$^{tob}$ and hGH-$^{XmaI}$(SP)$_{10}$ ((SP)$_{10}$ disclosed as SEQ ID NO: 51) to generate the plasmid designated pUC_SS$^{tob}$-(SP)$_{10}$-hGH-(SP)$_{10}$ ((SP)$_{10}$ disclosed as SEQ ID NO: 51) (FIG. 23). The extra nucleotides introduced into this plasmid for cloning purpose were then removed by site-directed mutagenesis using the Quick-Change Mutagenesis kit (Strategies, CA). (pUC-SS$^{tob}$-$^{XmaI}$hGH-(SP)$_{10}$ ((SP)$_{10}$ disclosed as SEQ ID NO: 51) is the preliminary pUC-SS$^{tob}$-hGH-(SP)$_{10}$ plasmid ((SP)$_{10}$ disclosed as SEQ ID NO: 51) without subject to site-directed mutation to remove the XmaI restriction site.

6. hGHA-(SO)$_{10}$ (hGHA: Human Growth Hormone Antagonist) ((SO)$_{10}$ Disclosed as SEQ ID NO: 4)

pUC-SS$^{tob}$-hGHA-(SP)$_{10}$((SP)$_{10}$ disclosed as SEQ ID NO: 51) (FIG. 24) was generated by site-directed mutagenesis of plasmid pUC-SS$^{tob}$-hGH-(SP)$_{10}$ ((SP)$_{10}$ disclosed as SEQ ID NO: 51) (from encoding Gly$^{120}$ to encoding Lys$^{120}$) using the following primer set:

```
                                          (SEQ ID NO: 147)
5'-GGACCTAGAGGAAAAGATCCAAACGCTG-3'
and
                                          (SEQ ID NO: 148)
5'-CAGCGTTTGGATCTTTTCCTCTAGGTCC-3'.
```

Example 4

Additional Examples of Interferon Constructs

In addition to the interferon alpha2 construct (INF-(SO)$_{10}$) ((SO)$_{10}$ disclosed as SEQ ID NO: 4) described in Example 2 above, the following additional constructs were made.

1. INF-(SO)$_5$ ((SO)$_5$ Disclosed as SEQ ID NO: 143)

SS$^{tob}$-INF-(SP)$_5$ ((SP)$_5$ disclosed as SEQ ID NO: 92) gene fragment was amplified with PCR using pUC-SS$^{tob}$-INF-(SP)$_{10}$ ((SP)$_{10}$ disclosed as SEQ ID NO: 51) as template and the following primer set:

```
                                          (SEQ ID NO: 139)
5'-AGAGGATCCGCAATGGGAAAAATGGC-3'
and
                                          (SEQ ID NO: 141)
5'-TAAGTGTACAATCAAGGCGATGGGGAAGGGCTTGG-3'
```

The resulting PCR fragment was sub-cloned into pUC-SS$^{tob}$-EGFP as a BamHI/BsrGI fragment, replacing SS$^{tob}$-EGFP, to generate the plasmid designated pUC-SS$^{tob}$-INF-(SP)$_5$ ((SP)$_5$ disclosed as SEQ ID NO: 92) (FIG. 25). This transformation was performed in *Arabidopsis thaliana* cells.

2. (SO)$_5$-INF-(SO)$_5$ ((SO)$_5$ Disclosed as SEQ ID NO: 143)

SS$^{tob}$-(SP)$_5$ ((SP)$_5$ disclosed as SEQ ID NO: 92) gene fragment was amplified with PCR using pUC_SS$^{tob}$-(SP)$_{10}$-hGH-(SP)$_{10}$ as template ((SP)$_{10}$ disclosed as SEQ ID NO: 51) and the following primer set:

```
                                          (SEQ ID NO: 139)
5'-AGAGGATCCGCAATGGGAAAAATGGC-3'
and
                                          (SEQ ID NO: 137)
5'-ATAAGGCCCGGGTAGGCGATGGGGAAGGGCTTG-3'
```

The resulting PCR fragment was sub-cloned into pUC-SS$^{tob}$-INF-(SP)$_5$((SP)$_5$ disclosed as SEQ ID NO: 92) as a BamHI/XmaI fragment, replacing SS$^{tob}$, to generate the plasmid designated pUC-SS$^{tob}$-(SP)$_5$-INF-(SP)$_5$ ((SP)$_5$ disclosed as SEQ ID NO: 92) (FIG. 26). The extra nucleotides introduced into this plasmid for cloning purpose were then removed by site-directed mutagenesis using the Quick-Change Mutagenesis kit (Strategies, CA). This transformation was performed in *Arabidopsis thaliana* cells.

3. (SO)$_5$-INF ((SO)$_5$ Disclosed as SEQ ID NO: 143)

SS$^{tob}$-(SP)$_5$ ((SP)$_5$ disclosed as SEQ ID NO: 92) gene fragment was amplified with PCR as above. The resulting PCR fragment was sub-cloned into pUC-SS$^{tob}$-INF as a BamHI/XmaI fragment, replacing SS$^{tob}$, to generate the plasmid designated pUC-SS$^{tob}$-(SP)$_5$-INF ((SP)$_5$ disclosed as SEQ ID NO: 92) (FIG. 27). The extra nucleotides introduced into this plasmid for cloning purpose were then removed by site-directed mutagenesis using the QuickChange Mutagenesis kit (Strategies, CA). This transformation was performed in *Arabidopsis thaliana* cells.

4. INF-(SO)$_{20}$ ((SO)$_{20}$ Disclosed as SEQ ID NO: 144)

A NcoI restriction site was first introduced right after SS$^{tob}$-INF-(SP)$_{10}$ ((SP)$_{10}$ disclosed as SEQ ID NO: 51) gene fragment with PCR using pUC-SS$^{tob}$-INF-(SP)$_{10}$ ((SP)$_{10}$ disclosed as SEQ ID NO: 51) as template and the following primer set:

```
                                            (SEQ ID NO: 139)
    5'-AGAGGATCCGCAATGGGAAAAATGGC-3'
    and
                                            (SEQ ID NO: 142)
    5'-ATAAGCCATGGTTGGGCTGGGAGAAGGGGATGG-3'
```

The resulting PCR fragment, SS$^{tob}$-INF-(SP)$_{10}$$^{NcoI}$((SP)$_{10}$ disclosed as SEQ ID NO: 51) was then sub-cloned into pUC-SS$^{tob}$-hGH$^{NcoI}$-(SP)$_{10}$ ((SP)$_{10}$ disclosed as SEQ ID NO: 51) as a BamHI/NcoI fragment, replacing, SS$^{tob}$-INF$^{NcoI}$, to generate the plasmid designated pUC-SS$^{tob}$-INF-(SP)$_{20}$ ((SP)$_{20}$ disclosed as SEQ ID NO: 93) (FIG. 28). The extra nucleotides introduced into this plasmid for cloning purpose were then removed by site-directed mutagenesis using the QuickChange Mutagenesis kit (Strategies, CA). This transformation was performed in tobacco cells.

5. (SO)$_{10}$-INF_(SO)$_{10}$ ((SO)$_{10}$ Disclosed as SEQ ID NO: 4)

A SS$^{tob}$-(SP)$_{10}$ ((SP)$_{10}$ disclosed as SEQ ID NO: 51) fragment was generated by digestion of pUC_SS$^{tob}$-(SP)$_{10}$$^{XmaI}$-hGH-(SP)$_{10}$*((SP)$_{10}$ disclosed as SEQ ID NO: 51) with BamHI/XmaI. This fragment was then sub-cloned into pUC-SS$^{tob}$-INF-(SP)$_{10}$ ((SP)$_{10}$ disclosed as SEQ ID NO: 51), replacing SS$^{tob}$, to generate the plasmid designated pUC_SS$^{tob}$-(SP)$_{10}$-INF-(SP)$_{10}$ ((SP)$_{10}$ disclosed as SEQ ID NO: 51) (FIG. 29). The extra nucleotides introduced into this plasmid for cloning purpose were then removed by site-directed mutagenesis using the QuickChange Mutagenesis kit (Strategies, CA). (*: pUC_SS$^{tob}$-(SP)$_{10}$$^{XmaI}$-hGH-(SP)$_{10}$ ((SP)$_{10}$ disclosed as SEQ ID NO: 51) is the preliminary pUC_SS$^{tob}$-(SP)$_{10}$-hGH-(SP)$_{10}$ ((SP)$_{10}$ disclosed as SEQ ID NO: 51) plasmid without subject to site-directed mutation to remove the XmaI restriction site. This transformation was performed in tobacco cells.

Example 5

Prophetic Examples of EGFP Fusion Proteins

Other EGFP fusion proteins that can be made in accordance with the present invention include, but are not limited to, (Ala-Hyp)$_{11}$-EGFP (peptide disclosed as SEQ ID NO: 149), (Thr-Hyp)$_{11}$-EGFP (peptide disclosed as SEQ ID NO: 150), (Thr-Hyp)$_{101}$-EGFP (peptide disclosed as SEQ ID NO: 151), and (Val-Hyp)$_{11}$-EGFP (peptide disclosed as SEQ ID NO: 152). These are just a few of the examples that are specifically contemplated. The invention is hardly limited to these examples; essentially any combination or number of X-Hyp repeats can be made (where X is an amino acid and Hyp is hydroxyproline).

Example 6

Improving the Biological Characteristics of Peptides by Glycosylation

Human growth hormone (hGH) is a polypeptide hormone secreted by the pituitary gland and transported by the blood to target tissues such as the liver, muscle, bone, and adipose. Human GH induces metabolic changes in the target tissues, ultimately stimulating the processes that result in body growth. Hyposecretion of hGH results in dwarfism and hypersecretion results in gigantism and acromegaly. Additionally, hGH influences the metabolism of adipocytes and muscle cells and processes such as aging; hence, the intense interest in manipulating hGH levels in blood and tissues.

Despite these important utilities, native or recombinant GH is generally unsuitable as a polypeptide drug because its small size results in rapid kidney clearance and a very short circulating half-life (~30 min). Thus, patients undergoing treatment for dwarfism require too-frequent injections of hGH.

The attachment of polyethylene glycol (PEG) groups to lysine residues in the polypeptide—a process called PEGylation—dramatically improves the pharmacological properties of hGH. PEGylation makes hGH more clinically effective by increasing its molecular mass, thereby preventing renal filtration and slowing clearance of hGH from the body; it also protects the polypeptide from proteolysis and reduces immunogenicity.

PEGylation has some drawbacks however. The relatively non-specific targeting of lysine residues dramatically reduces receptor binding affinities, by as much as 1500-fold. Furthermore, the process of PEGylation is time-consuming and inconvenient, as it requires purification of the derivatized polypeptide, greatly increasing drug costs.

This Example describes work in which the inventors increased the effective molecular weight of hGH and its corresponding circulating stability by expressing it in plant cells as a glycoprotein.

Materials and Methods

Construction of the plant transformation plasmid pBI SS$^{tob}$-hGH-(SP)$_{10}$ pBI121 ((SP)$_{10}$ disclosed as SEQ ID NO: 51) is a plasmid commercially available from Clontech. A derivative of it was made for this work.

Human growth hormone cDNA was produced by RT-PCR from the total RNA extracted from mouse L-cells stably transfected with hGH gene (Chen et al, 1994) using the following primer set: 5'-ACCCGGGCCTTCCCAACCATTC-CCTTATCC-3' (SEQ ID NO: 153) and 5'-GATTCCATGGT-GAAGCCACAGCTGCCCTCCAC-3' (SEQ ID NO: 91). The resulting PCR fragment contained the open reading frame for hGH but lacked its signal peptide. This fragment was cloned into pUC-SS$^{tob}$-EGFP as an XmaI/NcoI fragment between SS$^{tob}$, which encodes the extensin signal sequence (SS) from tobacco, and the gene for enhanced green fluorescent protein (EGFP) to generate the plasmid designated pUC-SS$^{tob}$-hGH-EGFP. The synthetic gene encoding ten repeats of the dipeptide Ser-Pro (SP)$_{10}$ ((SP)$_{10}$ disclosed as SEQ ID NO: 51) was constructed by primer extension of two mutually priming oligonucleotides (Integrated DNA Technologies, Inc. Coralville, Iowa) (FIG. 10B)

The (SP)$_{10}$ gene ((SP)$_{10}$ disclosed as SEQ ID NO: 51) was subcloned into pUC-SS$^{tob}$-hGH-EGFP as a NcoI and BsrGI fragment, replacing EGFP to generate pUC-SS$^{tob}$-hGH-(SP)$_{10}$. ((SP)$_{10}$ disclosed as SEQ ID NO: 51) The extra nucleotides introduced into the SS$^{tob}$-hGH-(SP)$_{10}$ ((SP)$_{10}$ disclosed as SEQ ID NO: 51) Gene cassette for cloning purpose were then removed by site-directed mutagenesis using the QuickChange Mutagenesis kit (Strategies, CA). Sequencing of SS$^{tob}$-hGH-(SP)$_{10}$ ((SP)$_{10}$ disclosed as SEQ ID NO: 51) was performed in Department of Environmental and Plant Biology, Ohio University.

The entire SS$^{tob}$-hGH-(SP)$_{10}$ ((SP)$_{10}$ disclosed as SEQ ID NO: 51) construct (FIG. 10A) was then cloned into plant transformation vector pBI121 (Clontech, CA) as a BamHI and SacI fragment in place of the β-glucuronidase reporter gene to give plasmid pBI-SS$^{tob}$-hGH-(SP)$_{10}$ ((SP)$_{10}$ disclosed as SEQ ID NO: 51). The expression of SS$^{tob}$-hGH-(SP)$_{10}$ ((SP)$_{10}$ disclosed as SEQ ID NO: 51) was under the control of the 35S cauliflower mosaic virus promoter.

Plant Cell Transformation and Selection

Plasmid pBI-SS$^{tob}$-hGH-(SP)$_{10}$ ((SP)$_{10}$ disclosed as SEQ ID NO: 51) was introduced into *Agrobacterium tumefaciens* strain LBA4404 by the freeze-thaw method (Holsters et al., 1978), then suspension-cultured tobacco cells (*Nicotiana tabacum*, BY2) were transformed with the *Agrobacterium* as described earlier (An, G. (1985) High efficiency transformation of cultured tobacco cells. Plant Physiol, 79:568-570) and selected on solid Schenk & Hildebrandt (SH) medium (Schenk and Hildebrandt, (1972) Medium and techniques for induction and growth of monocotyledonous and dicotyledonous plant cell cultures. Can J Bot, 50:199-204) containing 0.4 mg/L 2,4-dichlorophenoxyacetic acid (2,4-D), 200 mg/L kanamycin (Sigma), and 400 mg/L TIMENTIN (SmithKline Beecham, Pa.).

For production of the transgene product, cells were gown in liquid SH medium comprised of the same components as above, except excluding TIMENTIN. After 8 to 10 days of culture at room temperature on an Innova gyrotary shaker (New Brunswick Scientific, Edison, N.J.), rotating at 90 rpm, the culture medium for each cell line was screened for hGH expression by dot blotting and ELISA assay (see below). Three high-yield cell lines were chosen for subculture under the conditions described above.

Isolation of the hGH-(SO)$_{10}$ Fusion Glycoprotein ((SO)$_{10}$ Disclosed as SEQ ID NO: 4)

The medium from transformed cells was harvested after 8-10 days of culture by filtration on a coarse sintered funnel and supplemented with sodium chloride to a final concentration of 2 M. Insoluble material was pelleted by centrifugation at 25,000×G for 20 min at 4 C. The supernatant was fractionated by hydrophobic-interaction chromatography (HIC) on a Phenyl-Sepharose 6 column (Phenyl-Sepharose 6 Fast Flow, 16 by 700 mm, Amersham Pharmacia Biotech) equilibrated in 2 M sodium chloride. After the medium was completely loaded onto the HIC column, the proteins were eluted stepwise first with Tris buffer (25 mM, pH8.5)/2M sodium chloride, followed by Tris buffer (25 mM, pH8.5)/0.8M sodium chloride, and then the Tris buffer (25 mM, pH8.5)/0.2N sodium chloride. The flow rate was 1.0 ml/min, and the fractions were monitored at 220 nm with a UV detector. Each elute fraction was assayed for the presence of hGH by dot blots and ELISA assays. The Tris buffer (25 mM, pH8.5)/ 0.2N NaCl fraction containing most of the hGH-(SO)$_{10}$ fusion glycoprotein ((SO)$_{10}$ disclosed as SEQ ID NO: 4) was concentrated by ultrafiltration at 4° C., and either used for hGH binding and activity assays, or further purification by reversed phase chromatography.

Each eluate fraction was assayed for the presence of hGH by dot blots and ELISA assays. The fraction from the HIC column, which contained the fusion glycoprotein (designated hGH-(SO)$_{10}$ ((SO)$_{10}$ disclosed as SEQ ID NO: 4)), was concentrated by ultrafiltration at 4° C. and either used for hGH binding and activity assays The HIC hGH-(SO)$_{10}$ ((SO)$_{10}$ disclosed as SEQ ID NO: 4) rich fraction further fractionated by reversed phase chromatography on a Hamilton polymeric reversed phase-1 (PRP-1) analytical column (4.1×150 mm, Hamilton Co., Reno, Nev.) equilibrated with buffer A (0.1% trifluoroacetic acid). Proteins were eluted with buffer B (0.1% trifluoroacetic acid, 80% acetonitrile, v/v) using a two-step linear gradient of 0-30% B in 15 min, followed by 30%-70% B in 90 min at a flow rate of 0.5 ml/min. Absorbance was measured at 220 nm.

Western Blot Analysis

Samples (10-µg) of hGH-(SO)$_{10}$ ((SO)$_{10}$ disclosed as SEQ ID NO: 4) were mixed with an equal volume of 2× reducing sample buffer and electrophoresed on a 4-12% SDS-polyacrylamide gel (BioRad, CA), then transferred to a NitroBind membrane (MSI, Westboro, Mass.) using a BioRad mini Trans-Blot cell. Rabbit polyclonal anti-hGH antibody (Fitzgerald Industries International, Concord, Mass.) diluted at 1:500 in TTBS buffer (100 mM Tris-HCl, pH 7.5, 150 mM NaCl, and 0.1% Tween 20) and alkaline phosphatase-conjugated goat anti-rabbit IgG (Sigma) diluted at 1:1000 in TTBS buffer were used as primary and secondary antibodies, respectively.

Quantification of hGH by ELISA

The concentration of hGH equivalents in the medium or in column eluant was determined using a sandwich hGH ELISA kit (Roche Molecular Biochemicals, Germany) according to manufacturer's instructions.

Glycosyl Composition and Hydroxyproline Glycoside Profiles

Neutral sugars were analyzed as alditol acetates derivatives by gas chromatography using a Hewlett-Packard HP-5 column (crosslinked 5% PH ME Siloxane, 30 m×0.32 mm×0.25 µm) programmed from 130° C. to 177° C. at 1.2° C./min. Data were captured by Hewlett-Packard ChemStation software. One hundred µg of hGH-(SO)$_{10}$ ((SO)$_{10}$ disclosed as SEQ ID NO: 4) was used for each analysis with 50 nmol of myo-inositol as the internal standard. Uronic acids were assayed by the colorimetric method based on reaction with m-hydroxydiphenyl, with D-glucuronic acid as the standard.

Amino Acid Sequencing and Composition Assay

The N-terminal amino acid sequence of hGH-(SO)$_{10}$ ((SO)$_{10}$ disclosed as SEQ ID NO: 4) was determined at the Michigan State University Macromolecular Facility on a 477-A Applied Biosystems Gas Sequencer. The hGH-(SO)$_{10}$ amino acid composition ((SO)$_{10}$ disclosed as SEQ ID NO: 4) was determined by reversed phase HPLC on a Beckman Gold System (Beckman Instruments Inc., CA) after hydrochloric acid hydrolysis and subsequent phenylisothiocyanate derivatization (Bergman, T, Carlquist, M, Jornvall, H. (1986) Amino acid analysis by high performance liquid chromatography of phenylthiocarbamyl derivatives. In: Wittmann-liebold B, editor. Advanced Methods in Protein Microsequence Analysis. Berlin: Springer-Verlag. p 45-55). The Hyp content of samples was assayed colorimetrically as described earlier (Kivirikko, K. I. and Liesmaa, M. (1959) A colorimetric method for determination of hydroxyproline in tissue hydrolysates. Scandinavian J Clin Lab, 11:128-131).

TABLE 9

Amino acid composition and N-terminal sequence of hGH-(SO)$_{10}$ ((SO)$_{10}$ disclosed as SEQ ID NO: 4)

| Amino Acid | Composition (mol %) | | |
|---|---|---|---|
| | hGH(SO)$_{10}$ | hGH(SO)$_{10}$ cDNA | Predicted [c] |
| Hyp | 4.5 | — | 4.7 |
| Pro | 6.8 | 8.5 | 3.8 |

TABLE 9 -continued

Amino acid composition and N-terminal sequence of hGH-(SO)$_{10}$((SO)$_{10}$ disclosed as SEQ ID NO: 4)

| Asx[a] | 2.5 | 9.5 | 9.5 |
|---|---|---|---|
| Glx[b] | 14.6 | 12.8 | 12.8 |
| Thr | 3.9 | 5.2 | 5.2 |
| Ser | 14.8 | 13.7 | 13.7 |
| Gly | 5.6 | 3.8 | 3.8 |
| Ala | 7.4 | 3.3 | 3.3 |
| Val | 3.1 | 3.3 | 3.3 |
| Met | 1.8 | 0.5 | 0.5 |
| Ile | 3.1 | 3.3 | 3.3 |
| Leu | 9.7 | 12.3 | 12.3 |
| Tyr | 2.0 | 3.8 | 3.8 |
| Phe | 5.2 | 6.2 | 6.2 |
| His | 2.9 | 0.5 | 0.5 |
| Lys | 6.9 | 4.3 | 4.3 |
| Arg | 4.6 | 4.7 | 4.7 |
| Cys | 0.5 | 1.9 | 1.9 |
| Trp | nd | 0.0 | 0.0 |

N-terminal sequence (main sequence) Phe-Pro-Thr-Ile-Pro-Leu-Ser-Arg-Leu-Phe-Asp-Asn-Ala-Met-Leu (SEQ ID NO: 154)
(minor sequence) Ser-His-Asn-Asp-Asp-Ala-Leu-Leu-Lys-Asn-Tyr-Gly-Leu-Leu-Tyr (SEQ ID NO: 155)

[a] Asx includes Asp and Asn
[b] Glx includes Glu and Gln
[c] predicted from the designed peptide sequence of hGH(SO)$_{10}$ glycoprotein ((SO)$_{10}$ disclosed as SEQ ID NO: 4) and Hyp contiguity theory (Shpak, E., Leykam, J.F., and Kieliszewski, M.J. (1999), Proceedings of the National Academy of Sciences (USA), 96: 14736-14741; Shpak, E., Barbar,E., Leykam, J.F. & Kieliszewski, M.J. J. Biol. Chem. 276, 11272-11278 (2001))

The major sequence above is the N-terminus of intact hGH-(SP)$_{10}$ ((SP)$_{10}$ disclosed as SEQ ID NO: 51), the minor sequence occurs after proteolytic cleavage at one labile site (N150-S151) in the hGH domain of hGH-(SP)$_{10}$ ((SP)$_{10}$ disclosed as SEQ ID NO: 51). Analysis of hGH expressed as a targeted protein in our BY-2 system showed it contained no Hyp, suggesting that hGH in our fusion glycoproteins contains Hyp only in the SO module. This amino acid composition indicates there are 9.5 Hyp residues in the 211 amino acid sequence.

Radioreceptor Binding Assays of hGH-(SO)$_{10}$ ((SO)$_{10}$ Disclosed as SEQ ID NO: 4)

Binding assays of hGH-(SP)$_{10}$ ((SP)$_{10}$ disclosed as SEQ ID NO: 51), isolated with HIC (Hydrophobic Interaction Chromatography), were performed using a monolayer cell surface binding assay.

Briefly, growth hormone receptor (GHR)-expressing NIH 3T3-L1 cells were grown to confluence in 12-well cell culture plates. The cells were depleted of serum overnight with plain DMEM. The cells were rinsed twice with 1 ml PBS containing 0.1% BSA at room temperature prior to the binding assay. Cells were incubated in the presence of a constant amount of [$^{125}$I]-hGH (Perkin Elmer) with varying amounts of GH preparations in 1-mL reaction volumes containing 0.1% BSA at room temperature for 2 hours on an orbital shaker. Binding reaction was terminated by rinsing cells 3 times with 1 mL of ice-cold PBS containing 0.1% BSA. Cells were solubilized with 0.1N NaOH and neutralized with 0.1N HCl and cell surface bound radioactivity was measured using a liquid scintillation counter.

Figure 30:
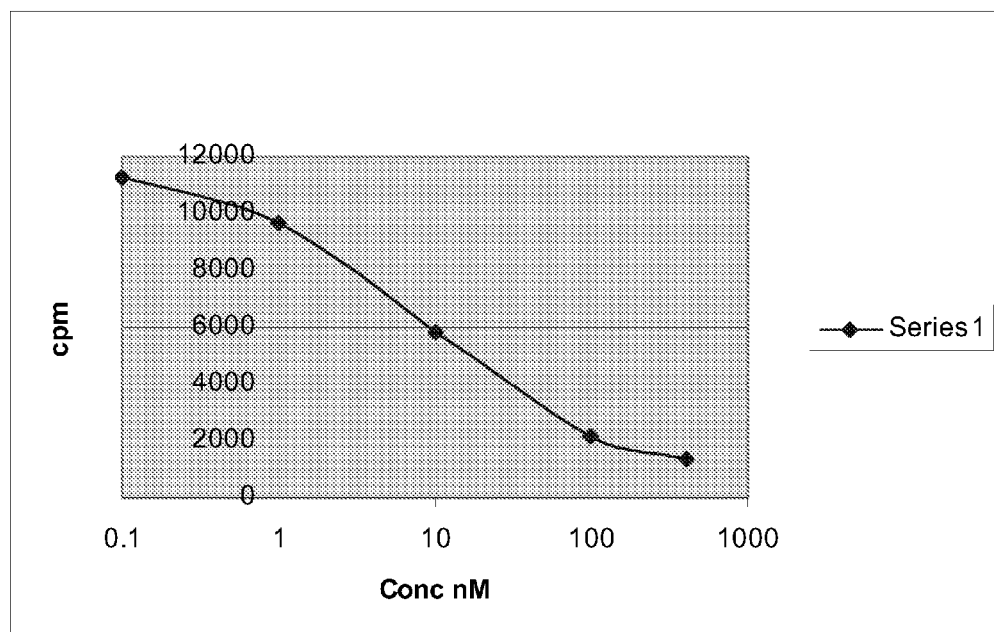
FIG. 30 shows a binding curve for hGH-(SP)$_{10}$-EGFP ((SP)$_{10}$ disclosed as SEQ ID NO: 51).

This binding assay was repeated with an hGH-(SP)$_{10}$-EGFP ((SP)$_{10}$ disclosed as SEQ ID NO: 51) construct. The results, presented in FIG. 30, show that even with green fluorescent protein attached, the modified hGH binds to the receptor with relatively high affinity (EC$_{50}$ of approximately 10 nM). The results also show that the glycosylation motif can be interiorly situated; it is not necessary that the glycosylation motif be on either terminus.

Figure 31:
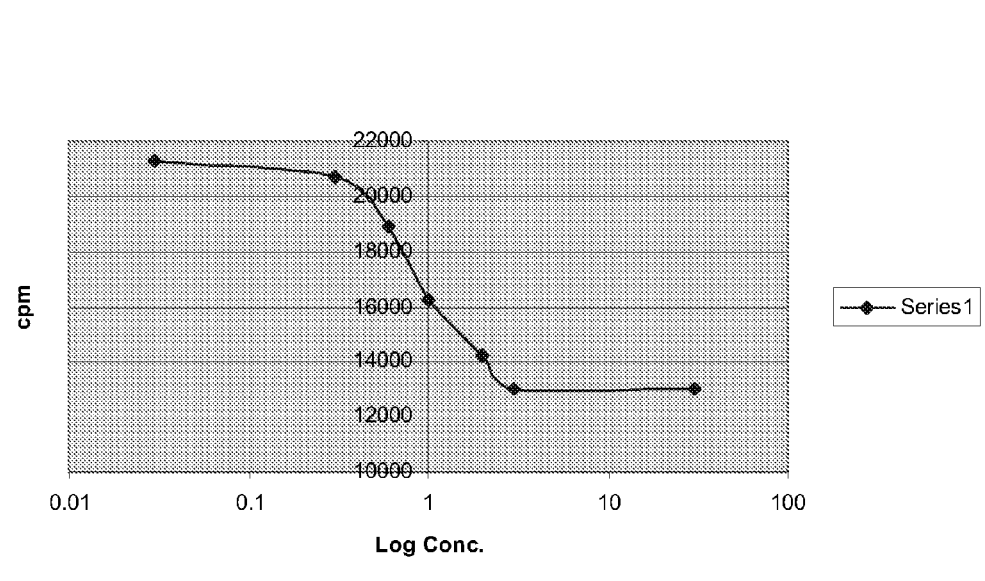
FIG. 31 shows a binding curve for commercially available hGH.
Figure 32:
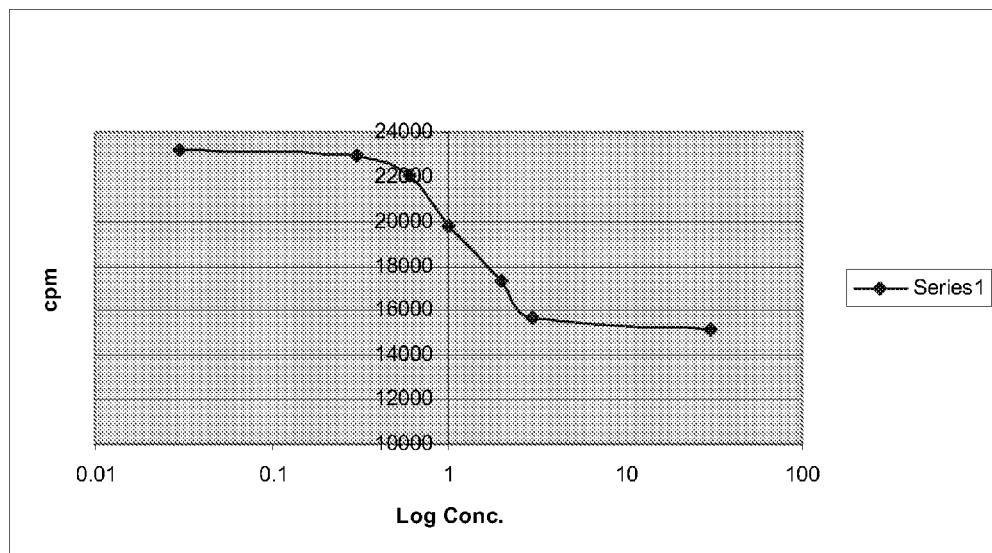
FIG. 32 shows a binding curve for hGH-(SP)$_{10}$ ((SP)$_{10}$ disclosed as SEQ ID NO: 51).

The results for the commercially available hGH for hGH-(SP)$_{10}$ ((SP)$_{10}$ disclosed as SEQ ID NO: 51) are presented in FIGS. 31 and 32. The EC$_{50}$ for hGH-(SP)$_{10}$ ((SP)$_{10}$ disclosed as SEQ ID NO: 51) was 1 nM, consistent with commercially available hGH binding of its receptor (FIG. 31).

In Vivo Effects of hGH-(SP)$_{10}$ ((SP)$_{10}$ Disclosed as SEQ ID NO: 51)

In order to determine the pharmacological effect and rate of clearance of the modified growth hormone, hGH-(SP)$_{10}$ ((SP)$_{10}$ disclosed as SEQ ID NO: 51) and commercially available hGH (Fitzgerald Industries International, Inc. 34 Junction Square Drive, Concord, Mass. 01742-3049 USA) were tested in mice.

For these tests, 5 to 6 month old C57BL/6J mice were injected intraperitoneally with GH samples prepared in PBS. Plasma was assayed for levels of growth hormone and insulin-like growth factor I ("IGF-1"; released by the body in response to growth hormone). (The growth hormone ELISA kits and IGF-1 kits were purchased from Diagnostic Systems Laboratories Inc.)

Figure 33:
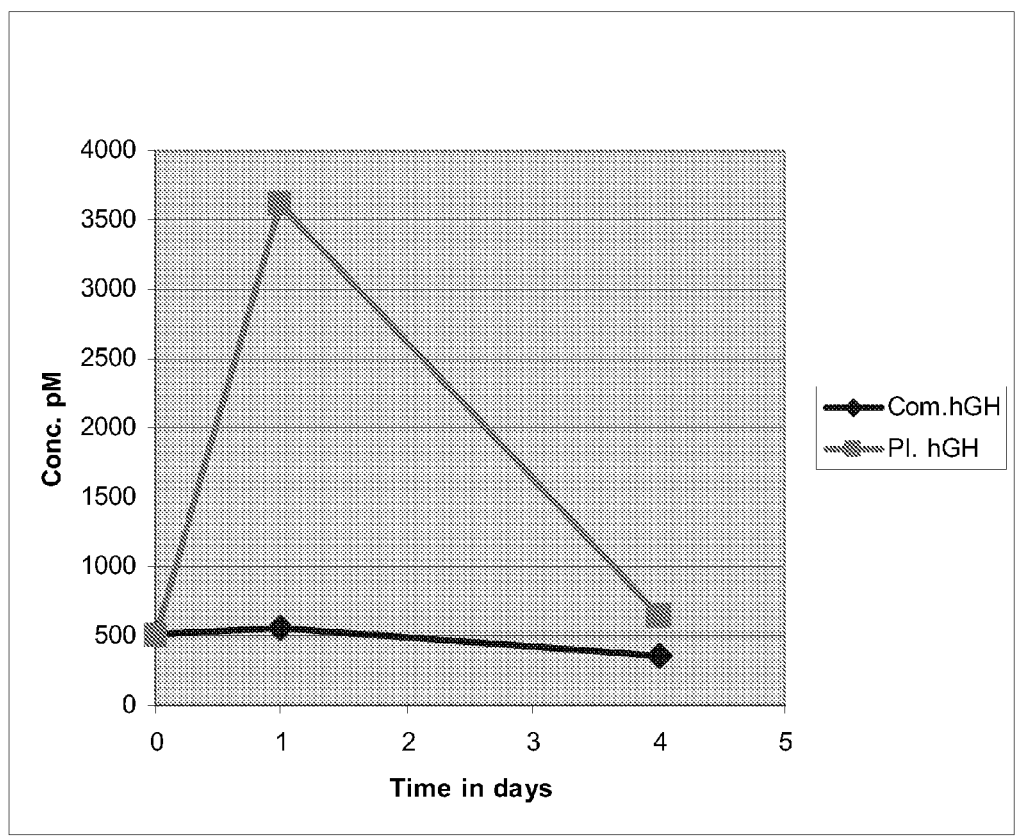
FIG. 33 shows serum concentration of commercially available hGH and hGH-(SP)$_{10}$ ((SP)$_{10}$ disclosed as SEQ ID NO: 51) following a single administration of each to mice.
Figure 34:
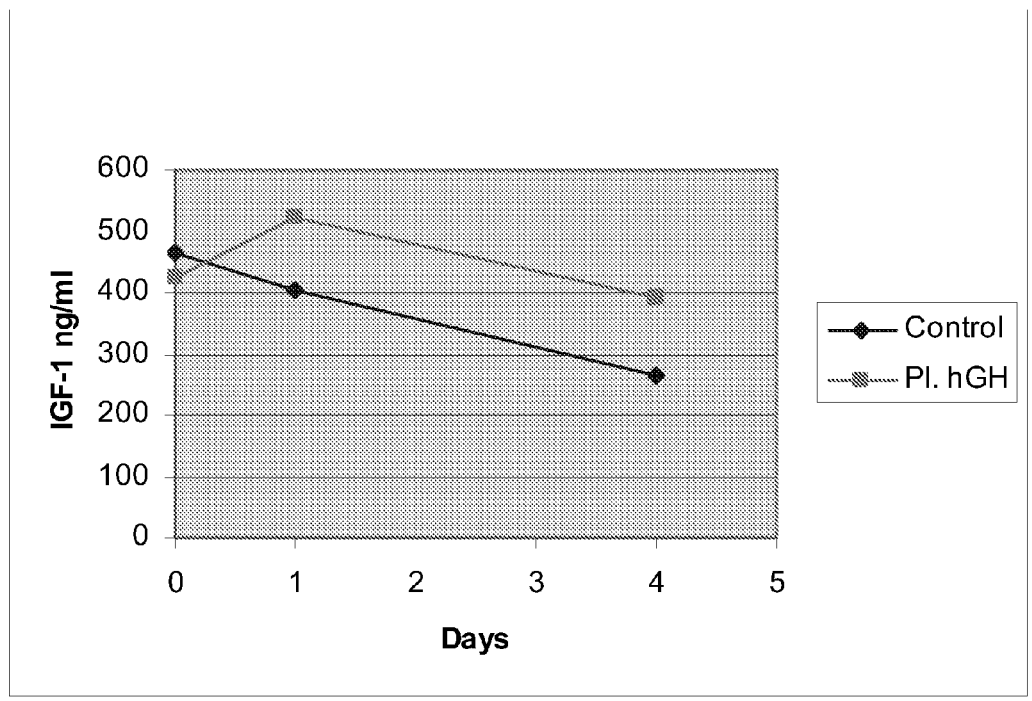
FIG. 34 shows serum IGF-1 concentration following a single administration to mice of commercially available hGH and hGH-(SP)$_{10}$ ((SP)$_{10}$ disclosed as SEQ ID NO: 51).

Test 1:

Single injection of 2 µg GH/g body weight. Plasma was sampled at 1 and 4 days after injection. The results are shown in FIG. 33 (growth hormone concentration) and 34 (IGF-1 concentration). Clearly, the hGH-(SP)$_{10}$ ((SP)$_{10}$ disclosed as SEQ ID NO: 51) exhibited a much higher concentration at the one-day measurement and exhibited a dramatically increased half-life and area under the curve. The IGF-1 levels show that the biological effect of GH was both enhanced and extended.

Figure 35:
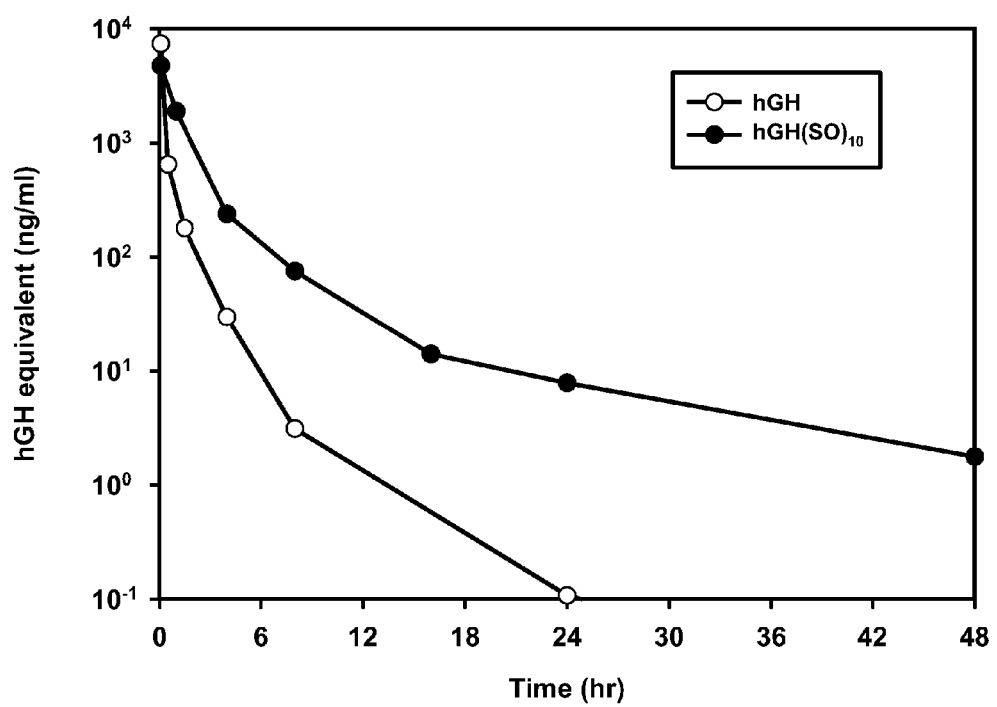
FIG. 35 shows blood concentration of hGH equivalents following a single administration of commercially available hGH and hGH-(SP)$_{10}$ ((SP)$_{10}$ disclosed as SEQ ID NO: 51) to mice.

In another test of hGH half-life, each group of mice (two) was given a single dose of 30 µg of hGH equivalent. Serum samples (30 µl) were taken over intervals extending to 48 hours and analyzed for hGH concentration by ELISA. The results, shown in FIG. 35, demonstrate a significant extension of plasma half-life by glycosylation.

Figure 36:
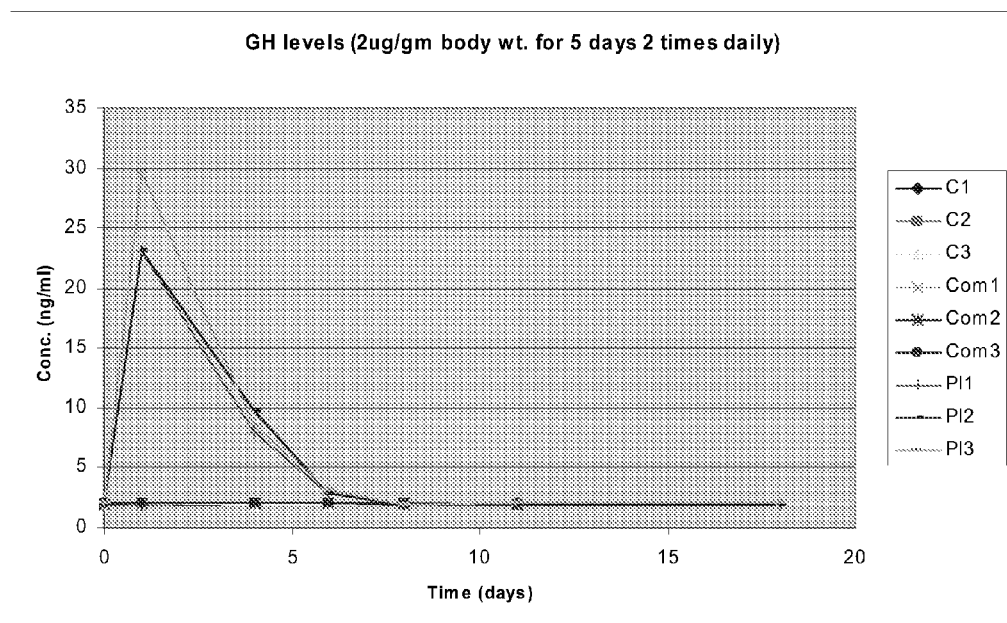
FIG. 36 shows serum concentration of commercially available hGH and hGH-(SP)$_{10}$ ((SP)$_{10}$ disclosed as SEQ ID NO: 51) (and PBS controls) following two administrations per day for five days to mice.
Figure 37:
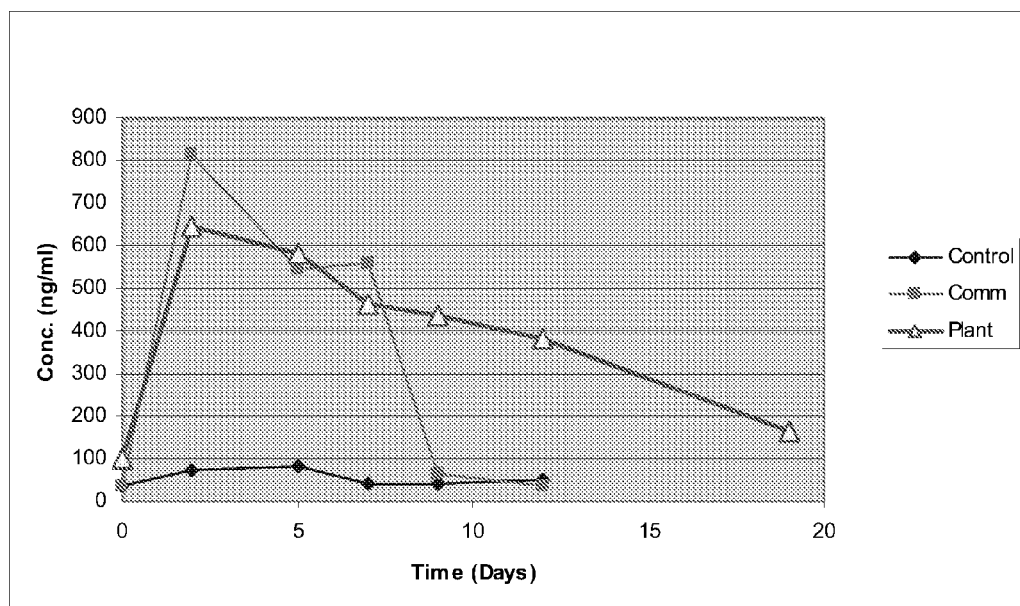
FIG. 37 shows serum IGF-1 concentration following administration of commercially available hGH and hGH-(SP)$_{10}$ ((SP)$_{10}$ disclosed as SEQ ID NO: 51) (and PBS control) following two administrations per day for five days to mice.

Test 2:

2 µg GH/g body weight/day. The growth hormone (modified and control) was administered daily as two injections, 12 hours apart, for 5 days. Plasma was sampled at 1, 4, 6, 8, 11, and 18 days after the first injection. The results are shown in FIGS. 36 and 37. FIG. 36 shows the serum concentration of growth hormone; FIG. 37 shows the serum concentration of IGF-1.

Again, note how GH levels (FIG. 36) are insignificant at one day with a commercial growth hormone preparation, whereas the glycosylated form has a much higher concentration at day one. The biological effect (shown in FIG. 37) for the commercially available growth hormone essentially ceases less than 5 days after the last administration (on day 5), whereas the glycosylated form continues to produce measurable IGF-1 levels more than two weeks after the last administration. These results suggest that this may be the longest acting growth hormone ever developed.

Figure 38:
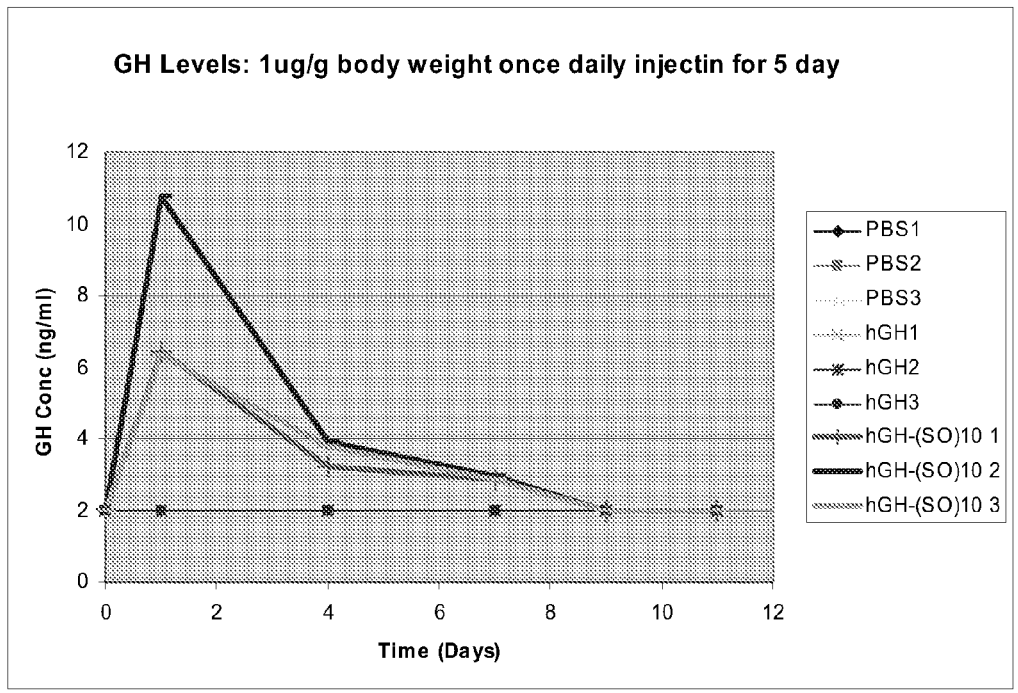
FIG. 38 shows growth hormone levels following once daily administration of a lower concentration (1 µg/gm) of commercially available hGH and hGH-(SP)$_{10}$ ((SP)$_{10}$ disclosed as SEQ ID NO: 51) (and PBS control) for five days.
Figure 39:
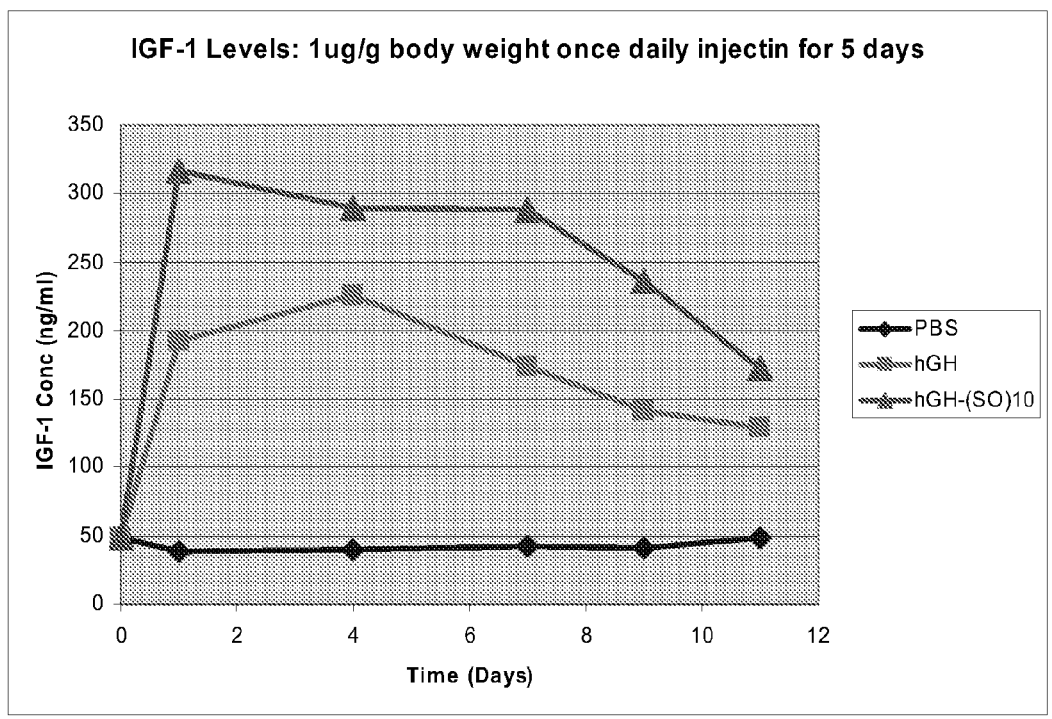
FIG. 39 shows serum IGF-1 concentration following administration of a lower concentration (1 µg/gm) of commercially available hGH and hGH-(SP)$_{10}$ ((SP)$_{10}$ disclosed as SEQ ID NO: 51) (and PBS control) following one administration per day for five days.

Test 3:

1 μg GH/g body weight/day. The GH was administered in single daily injections for 5 days and plasma was sampled at 1, 4, 7, 9, and 11 days after the first injection. The results are shown in FIGS. 38 and 39. Even at this lower dose, a significant difference is observed between the commercially available growth hormone and the glycosylated form of the invention.

Test 4:

Effects of hGH-$(SO)_{10}$ ($(SO)_{10}$ disclosed as SEQ ID NO: 4) on whole body growth.

Seven- to eight-week old mice were randomly divided into 3 treatment groups, i.e., control (n=3), hGH (n=3), and hGH-$(SO)_{10}$ (n=4) ($(SO)_{10}$ disclosed as SEQ ID NO: 4). Mice were caged in groups of two or three individuals. hGH (Fittzgerald, Concord Mass.) and hGH-$(SO)_{10}$ ($(SO)_{10}$ disclosed as SEQ ID NO: 4) were prepared at 100 μg/mL in PBS. Mice were intraperitoneally injected with a total dose of 1 μg per gram of body weight, twice daily at about 9 AM and 9 PM, for six days. After a one-day intermission, dosage was increased to 2 μg per gram of body weight for an additional 7 days.

Figure 40:
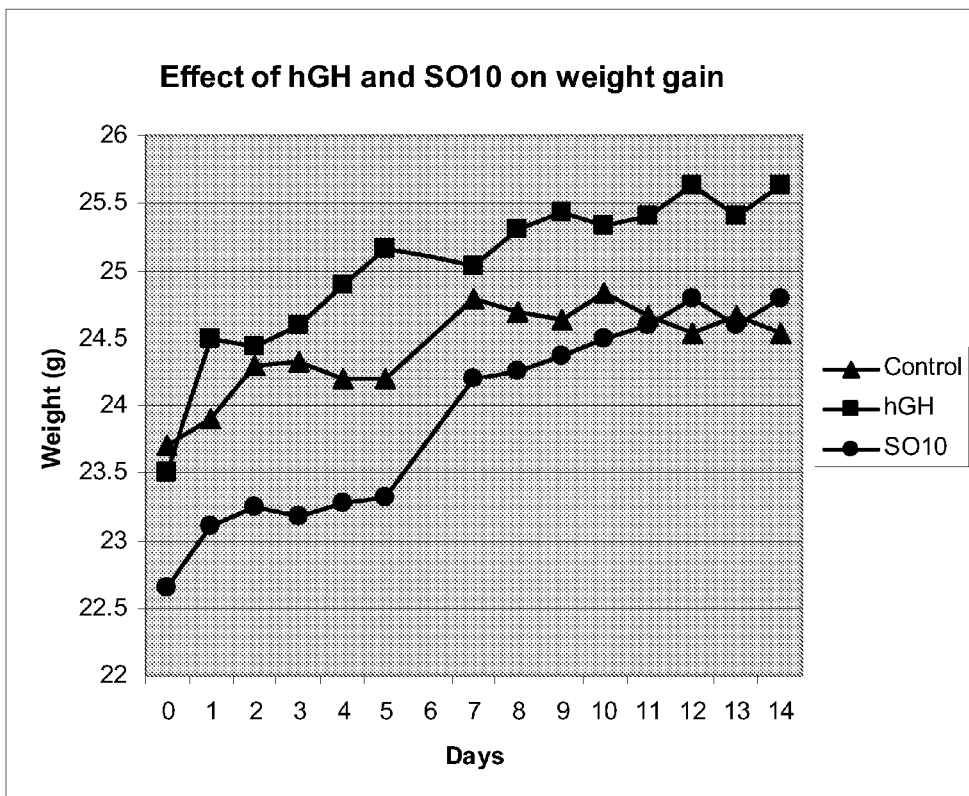
FIG. 40 shows the increase in body mass over the course of a two-week treatment with commercially available hGH and hGH-(SP)$_{10}$ ((SP)$_{10}$ disclosed as SEQ ID NO: 51).

FIG. 40 shows the weight gain of the mice in the test. Briefly, control mice gained average of 0.83 g over two-week period. Mice receiving hGH gained an average of 2.13 g and mice received hGH-$(SO)_{10}$ ($(SO)_{10}$ disclosed as SEQ ID NO: 4) gained average of 2.15 g over the two-week period. Weight gain over control mice was significant ($p<0.05$, ANOVA) for both hGH and hGH-$(SO)_{10}$ ($(SO)_{10}$ disclosed as SEQ ID NO: 4) and there was no significant difference between hGH and hGH-$(SO)_{10}$ ($(SO)_{10}$ disclosed as SEQ ID NO: 4) treatments.

Immunogenicity Assay of hGH-$(SO)_{10}$ ($(SO)_{10}$ Disclosed as SEQ ID NO: 4)

hGH-$(SO)_{10}$ ($(SO)_{10}$ disclosed as SEQ ID NO: 4) was injected into mice to test its immunogenicity as compared to wild-type growth hormone.

Immunization Regimen:

Two female Balb/C mice (~6-7 weeks old) were bled and immunized four times at two-week intervals. Each mouse received 50 μg of hGH-$(SP)_{10}$ ($(SP)_{10}$ disclosed as SEQ ID NO: 51) subcutaneously split between 2 sites (right and left flank. 0.05 mL/site). Serum was frozen at −20° C. until assayed for antibody activity by ELISA.

ELISA Protocol:

EIA plates (NUNC polystyrene) are coated with 40 μg/mL immunogen (hGH-$(SP)_{10}$) ($(SP)_{10}$ disclosed as SEQ ID NO: 51) in carbonate-bicarbonate buffer, pH 9.0, 50 μL/well, and left overnight. An equal number of wells is coated with buffer only, $(SP)_{10}$ ($(SP)_{10}$ disclosed as SEQ ID NO: 51) only (20 μg/mL) or hGH only (20 μg/mL). Immunogen is decanted and 200 μL of PBS-5% BSA (+0.05% TWEEN-20, a polysorbate surfactant) is added per well for two hours at room temperature to block nonspecific binding.

BSA is decanted and to each well is added 50 μL (duplicate wells on both immunogen-coated and uncoated wells) of PBS-1% BSA only or mouse serum dilutions in PBS-BSA. Pre-immune serum and most recent serum sample is compared from same mouse on each plate.

Incubation is performed for four hours at room temperature or overnight at 4° C. The wells are washed 4× in PBS-Tween.

To each well is added 50 μl of a 1:5000 dilution of peroxidase-conjugated goat anti-mouse Ig (all isotypes) in PBS-BSA for one hour at room temperature. Wells are washed four times.

The assay is developed by addition of 50 μL/well of OPD substrate in citrate-phosphate buffer, pH 6. The reaction is stopped by addition of 500/well 12.5% sulfuric acid when good contrast between background and samples is seen. The ELISA is read at 490 nm.

Interpretation.

Both mice showed a strong antibody response to hGH after a single injection of hGH. The Antibody levels rose with repeated injection.

Both mice possessed marginally detectable antibody to purified $(SP)_{10}$ ($(SP)_{10}$ disclosed as SEQ ID NO: 51) after the $2^{nd}$ and $3^{rd}$ injections. The low response may be due to poor detection as a result of low binding of the purified $(SP)_{10}$ ($(SP)_{10}$ disclosed as SEQ ID NO: 51) antigen to the ELISA plate (see below), which would reduce the reactions seen.

Both mice had an unexpected high antibody level to the hGH-SP10 conjugate antigen even before immunization. Since pre-immune serum did not react with purified $(SP)_{10}$ ($(SP)_{10}$ disclosed as SEQ ID NO: 51) or hGH alone, this can be explained by the mice having preformed anti-$(SP)_{10}$ ($(SP)_{10}$ disclosed as SEQ ID NO: 51), a cross-reactive antibody to some other antigen they have seen. It is possible that it is only detected when conjugated to hGH because the hGH-$(SP)_{10}$ ($(SP)_{10}$ disclosed as SEQ ID NO: 51) conjugate strongly attached to the ELISA plate, allowing better detection of anti-$(SP)_{10}$ ($(SP)_{10}$ disclosed as SEQ ID NO: 51). While this is speculation, it is consistent with observations in other mice where plant materials produced background responses without immunization.

The OD values were higher to the hGH coated plates than to the hGH-$(SP)_{10}$ ($(SP)_{10}$ disclosed as SEQ ID NO: 51) coated plates, which may reflect a differential recognition or simply different levels of the recognized determinants on the two plates.

TABLE 10

| Time post-immunization | Mouse# | anti-SP10 (OD) | anti-hGH(OD) | anti-hGHSP10 (OD) |
|---|---|---|---|---|
| 1:100 serum dilution | | | | |
| 0 weeks | 1 | 0.05 | 0.26 | 0.97 |
|  | 2 | 0.05 | 0 | 0.87 |
| 2 weeks | 1 | 0.05 | 1.79 | 1.3 |
|  | 2 | 0.05 | 1.52 | 1.1 |
| 4 weeks | 1 | 0.14 | 2.48 | 2.06 |
|  | 2 | 0.1 | 2.27 | 1.87 |
| 6 weeks | 1 | 0.28 | 2.33 | 2.15 |
|  | 2 | 0.23 | 2.29 | 2.1 |
| 1:500 serum dilution | | | | |
| 0 weeks | 1 | 0.04 | 0.11 | 0.41 |
|  | 2 | 0.03 | 0.04 | 0.36 |
| 2 weeks | 1 | 0.03 | 1.16 | 0.55 |
|  | 2 | 0.02 | 0.83 | 0.46 |
| 4 weeks | 1 | 0.1 | 2.29 | 1.82 |
|  | 2 | 0.06 | 1.99 | 1.44 |
| 6 weeks | 1 | 0.16 | 2.23 | 1.98 |
|  | 2 | 0.15 | 2.15 | 1.86 |

Competition experiments were also performed using hGH-$(SO)_{10}$-coated plates, anti-hGH-$(SO)_{10}$ antibodies (1:10,000 serum dilution), and 100 μg/ml $(SO)_{10}$ ($(SO)_{10}$ disclosed as SEQ ID NO: 4) as competitive inhibitor of the antibody binding. A 5% inhibition of the reaction was observed.

In summary, the hGH fusion glycoprotein, designated hGH-$(SO)_{10}$($(SO)_{10}$ disclosed as SEQ ID NO: 4), contained at the C-terminus ten tandem repeats of the glycosylation site Ser-Hyp (SO), which directed the addition of rhamnoglucuronoarabinogalactan polysaccharides to each Hyp residue and increased the molecular mass of hGH from 22 kDa to about 50 kDa and the circulating half-life from minutes to several hours or even days. The EC50 for hGH-(SO)$_{10}$ ((SO)$_{10}$ disclosed as SEQ ID NO: 4) was 1 nM, consistent with wild type GH binding of its receptor; furthermore hGH-(SO)$_{10}$ ((SO)$_{10}$ disclosed as SEQ ID NO: 4) stimulated the phosphorylation of JAK 5 in cultured cells and ultimately produced the same physiological response as wild type hGH. Preliminary evaluation of the antigenicity of hGH-(SO)$_{10}$ ((SO)$_{10}$ disclosed as SEQ ID NO: 4) injected subcutaneously into mice indicates that it is not more immunogenic than wild-type growth hormone.

Other embodiments of the invention will be apparent to those skilled in the art from consideration of the specification and practice of the invention disclosed herein. It is intended that the specification and examples be considered as exemplary only, with a true scope and spirit of the invention being indicated by the following claims.

SEQUENCE LISTING (173 sequences)

SEQ ID NO: 1 - protein, 1002 aa, Artificial Sequence
  Description of Artificial Sequence: Synthetic amino acid motif
  VARIANT (1): Lys, Ser, Ala, Thr, Gly, or Val
  MOD_RES (3)..(1002): This region encompasses at least 2 to 1,000 residues of Hydroxyproline, and subject to having the minumum number of residues, any one or more of amino acid residues at positions 3 to 1,002 can either be present or absent
XPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 2 - protein, 1001 aa, Artificial Sequence
  Description of Artificial Sequence: Synthetic amino acid motif
  VARIANT (1): Lys, Ser, Ala, Thr, Gly, or Val
  MOD_RES (2)..(1001): This region encompasses at least 2 to 1,000 residues of Hydroxyproline, and subject to having the minumum number of residues, any one or more of amino acid residues 2 to 1,001 can either be present or absent
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 3 - protein, 2000 aa, Artificial Sequence
  Description of Artificial Sequence: Synthetic amino acid motif
  VARIANT (1): Lys, Ser, Ala, Thr, Gly, or Val
  MOD_RES (2): Hydroxyproline
  VARIANT (3): Lys, Ser, Ala, Thr, Gly, or Val
  MOD_RES (4): Hydroxyproline
  VARIANT (5): Lys, Ser, Ala, Thr, Gly, or Val
  MOD_RES (6): Hydroxyproline
  VARIANT (7): Lys, Ser, Ala, Thr, Gly, or Val
  MOD_RES (8): Hydroxyproline
  VARIANT (9): Lys, Ser, Ala, Thr, Gly, or Val
  MOD_RES (10): Hydroxyproline
  VARIANT (11): Lys, Ser, Ala, Thr, Gly, or Val
  MOD_RES (12): Hydroxyproline
  VARIANT (13): Lys, Ser, Ala, Thr, Gly, or Val
  MOD_RES (14): Hydroxyproline
  VARIANT (15): Lys, Ser, Ala, Thr, Gly, or Val
  MOD_RES (16): Hydroxyproline
  VARIANT (17): Lys, Ser, Ala, Thr, Gly, or Val
  MOD_RES (18): Hydroxyproline
  VARIANT (19): Lys, Ser, Ala, Thr, Gly, or Val
  MOD_RES (20): Hydroxyproline
  VARIANT (21): Lys, Ser, Ala, Thr, Gly, or Val
  MOD_RES (22): Hydroxyproline
  VARIANT (23): Lys, Ser, Ala, Thr, Gly, or Val
  MOD_RES (24): Hydroxyproline
  VARIANT (25): Lys, Ser, Ala, Thr, Gly, or Val
  MOD_RES (26): Hydroxyproline
  VARIANT (27): Lys, Ser, Ala, Thr, Gly, or Val
  MOD_RES (28): Hydroxyproline
  VARIANT (29): Lys, Ser, Ala, Thr, Gly, or Val
  MOD_RES (30): Hydroxyproline
  VARIANT (31): Lys, Ser, Ala, Thr, Gly, or Val
  MOD_RES (32): Hydroxyproline
  VARIANT (33): Lys, Ser, Ala, Thr, Gly, or Val
  MOD_RES (34): Hydroxyproline
  VARIANT (35): Lys, Ser, Ala, Thr, Gly, or Val
  MOD_RES (36): Hydroxyproline
  VARIANT (37): Lys, Ser, Ala, Thr, Gly, or Val
  MOD_RES (38): Hydroxyproline
  VARIANT (39): Lys, Ser, Ala, Thr, Gly, or Val
  MOD_RES (40): Hydroxyproline
  VARIANT (41): Lys, Ser, Ala, Thr, Gly, or Val
  MOD_RES (42): Hydroxyproline
  VARIANT (43): Lys, Ser, Ala, Thr, Gly, or Val
  MOD_RES (44): Hydroxyproline
  VARIANT (45): Lys, Ser, Ala, Thr, Gly, or Val
  MOD_RES (46): Hydroxyproline
  VARIANT (47): Lys, Ser, Ala, Thr, Gly, or Val
  MOD_RES (48): Hydroxyproline
  VARIANT (49): Lys, Ser, Ala, Thr, Gly, or Val
  MOD_RES (50): Hydroxyproline
  VARIANT (51): Lys, Ser, Ala, Thr, Gly, or Val
  MOD_RES (52): Hydroxyproline
  VARIANT (53): Lys, Ser, Ala, Thr, Gly, or Val
  MOD_RES (54): Hydroxyproline
  VARIANT (55): Lys, Ser, Ala, Thr, Gly, or Val
  MOD_RES (56): Hydroxyproline
  VARIANT (57): Lys, Ser, Ala, Thr, Gly, or Val
  MOD_RES (58): Hydroxyproline
  VARIANT (59): Lys, Ser, Ala, Thr, Gly, or Val
  MOD_RES (60): Hydroxyproline
  VARIANT (61): Lys, Ser, Ala, Thr, Gly, or Val
  MOD_RES (62): Hydroxyproline
  VARIANT (63): Lys, Ser, Ala, Thr, Gly, or Val
  MOD_RES (64): Hydroxyproline
  VARIANT (65): Lys, Ser, Ala, Thr, Gly, or Val
  MOD_RES (66): Hydroxyproline
  VARIANT (67): Lys, Ser, Ala, Thr, Gly, or Val
  MOD_RES (68): Hydroxyproline
  VARIANT (69): Lys, Ser, Ala, Thr, Gly, or Val
  MOD_RES (70): Hydroxyproline
  VARIANT (71): Lys, Ser, Ala, Thr, Gly, or Val
  MOD_RES (72): Hydroxyproline
  VARIANT (73): Lys, Ser, Ala, Thr, Gly, or Val
  MOD_RES (74): Hydroxyproline
  VARIANT (75): Lys, Ser, Ala, Thr, Gly, or Val
  MOD_RES (76): Hydroxyproline
  VARIANT (77): Lys, Ser, Ala, Thr, Gly, or Val
  MOD_RES (78): Hydroxyproline
  VARIANT (79): Lys, Ser, Ala, Thr, Gly, or Val
  MOD_RES (80): Hydroxyproline
  VARIANT (81): Lys, Ser, Ala, Thr, Gly, or Val
  MOD_RES (82): Hydroxyproline
  VARIANT (83): Lys, Ser, Ala, Thr, Gly, or Val
  MOD_RES (84): Hydroxyproline
  VARIANT (85): Lys, Ser, Ala, Thr, Gly, or Val
  MOD_RES (86): Hydroxyproline
  VARIANT (87): Lys, Ser, Ala, Thr, Gly, or Val
  MOD_RES (88): Hydroxyproline
  VARIANT (89): Lys, Ser, Ala, Thr, Gly, or Val
  MOD_RES (90): Hydroxyproline
  VARIANT (91): Lys, Ser, Ala, Thr, Gly, or Val
  MOD_RES (92): Hydroxyproline
  VARIANT (93): Lys, Ser, Ala, Thr, Gly, or Val
  MOD_RES (94): Hydroxyproline
  VARIANT (95): Lys, Ser, Ala, Thr, Gly, or Val
  MOD_RES (96): Hydroxyproline
  VARIANT (97): Lys, Ser, Ala, Thr, Gly, or Val
  MOD_RES (98): Hydroxyproline
  VARIANT (99): Lys, Ser, Ala, Thr, Gly, or Val
  MOD_RES (100): Hydroxyproline
  VARIANT (101): Lys, Ser, Ala, Thr, Gly, or Val
  MOD_RES (102): Hydroxyproline
  VARIANT (103): Lys, Ser, Ala, Thr, Gly, or Val
  MOD_RES (104): Hydroxyproline
  VARIANT (105): Lys, Ser, Ala, Thr, Gly, or Val
  MOD_RES (106): Hydroxyproline
  VARIANT (107): Lys, Ser, Ala, Thr, Gly, or Val
  MOD_RES (108): Hydroxyproline
  VARIANT (109): Lys, Ser, Ala, Thr, Gly, or Val
  MOD_RES (110): Hydroxyproline
  VARIANT (111): Lys, Ser, Ala, Thr, Gly, or Val
  MOD_RES (112): Hydroxyproline
  VARIANT (113): Lys, Ser, Ala, Thr, Gly, or Val
  MOD_RES (114): Hydroxyproline
  VARIANT (115): Lys, Ser, Ala, Thr, Gly, or Val
  MOD_RES (116): Hydroxyproline
  VARIANT (117): Lys, Ser, Ala, Thr, Gly, or Val
  MOD_RES (118): Hydroxyproline
  VARIANT (119): Lys, Ser, Ala, Thr, Gly, or Val
  MOD_RES (120): Hydroxyproline
  VARIANT (121): Lys, Ser, Ala, Thr, Gly, or Val
  MOD_RES (122): Hydroxyproline
  VARIANT (123): Lys, Ser, Ala, Thr, Gly, or Val
  MOD_RES (124): Hydroxyproline
  VARIANT (125): Lys, Ser, Ala, Thr, Gly, or Val
  MOD_RES (126): Hydroxyproline
  VARIANT (127): Lys, Ser, Ala, Thr, Gly, or Val
  MOD_RES (128): Hydroxyproline
  VARIANT (129): Lys, Ser, Ala, Thr, Gly, or Val
  MOD_RES (130): Hydroxyproline
  VARIANT (131): Lys, Ser, Ala, Thr, Gly, or Val
  MOD_RES (132): Hydroxyproline
  VARIANT (133): Lys, Ser, Ala, Thr, Gly, or Val
  MOD_RES (134): Hydroxyproline
  VARIANT (135): Lys, Ser, Ala, Thr, Gly, or Val
  MOD_RES (136): Hydroxyproline
  VARIANT (137): Lys, Ser, Ala, Thr, Gly, or Val
  MOD_RES (138): Hydroxyproline
  VARIANT (139): Lys, Ser, Ala, Thr, Gly, or Val
  MOD_RES (140): Hydroxyproline
  VARIANT (141): Lys, Ser, Ala, Thr, Gly, or Val
  MOD_RES (142): Hydroxyproline
  VARIANT (143): Lys, Ser, Ala, Thr, Gly, or Val
  MOD_RES (144): Hydroxyproline
  VARIANT (145): Lys, Ser, Ala, Thr, Gly, or Val
  MOD_RES (146): Hydroxyproline
  VARIANT (147): Lys, Ser, Ala, Thr, Gly, or Val
  MOD_RES (148): Hydroxyproline
  VARIANT (149): Lys, Ser, Ala, Thr, Gly, or Val
  MOD_RES (150): Hydroxyproline
  VARIANT (151): Lys, Ser, Ala, Thr, Gly, or Val
  MOD_RES (152): Hydroxyproline
  VARIANT (153): Lys, Ser, Ala, Thr, Gly, or Val
  MOD_RES (154): Hydroxyproline
  VARIANT (155): Lys, Ser, Ala, Thr, Gly, or Val
  MOD_RES (156): Hydroxyproline
  VARIANT (157): Lys, Ser, Ala, Thr, Gly, or Val
  MOD_RES (158): Hydroxyproline
  VARIANT (159): Lys, Ser, Ala, Thr, Gly, or Val
  MOD_RES (160): Hydroxyproline
  VARIANT (161): Lys, Ser, Ala, Thr, Gly, or Val
  MOD_RES (162): Hydroxyproline
  VARIANT (163): Lys, Ser, Ala, Thr, Gly, or Val
  MOD_RES (164): Hydroxyproline
  VARIANT (165): Lys, Ser, Ala, Thr, Gly, or Val
  MOD_RES (166): Hydroxyproline
  VARIANT (167): Lys, Ser, Ala, Thr, Gly, or Val
  MOD_RES (168): Hydroxyproline
  VARIANT (169): Lys, Ser, Ala, Thr, Gly, or Val
  MOD_RES (170): Hydroxyproline
  VARIANT (171): Lys, Ser, Ala, Thr, Gly, or Val
  MOD_RES (172): Hydroxyproline
  VARIANT (173): Lys, Ser, Ala, Thr, Gly, or Val
  MOD_RES (174): Hydroxyproline
  VARIANT (175): Lys, Ser, Ala, Thr, Gly, or Val
  MOD_RES (176): Hydroxyproline
  VARIANT (177): Lys, Ser, Ala, Thr, Gly, or Val
  MOD_RES (178): Hydroxyproline
  VARIANT (179): Lys, Ser, Ala, Thr, Gly, or Val
  MOD_RES (180): Hydroxyproline
  VARIANT (181): Lys, Ser, Ala, Thr, Gly, or Val
  MOD_RES (182): Hydroxyproline
  VARIANT (183): Lys, Ser, Ala, Thr, Gly, or Val
  MOD_RES (184): Hydroxyproline
  VARIANT (185): Lys, Ser, Ala, Thr, Gly, or Val
  MOD_RES (186): Hydroxyproline
  VARIANT (187): Lys, Ser, Ala, Thr, Gly, or Val
  MOD_RES (188): Hydroxyproline
  VARIANT (189): Lys, Ser, Ala, Thr, Gly, or Val
  MOD_RES (190): Hydroxyproline
  VARIANT (191): Lys, Ser, Ala, Thr, Gly, or Val
  MOD_RES (192): Hydroxyproline
  VARIANT (193): Lys, Ser, Ala, Thr, Gly, or Val
  MOD_RES (194): Hydroxyproline
  VARIANT (195): Lys, Ser, Ala, Thr, Gly, or Val
  MOD_RES (196): Hydroxyproline
  VARIANT (197): Lys, Ser, Ala, Thr, Gly, or Val
  MOD_RES (198): Hydroxyproline
  VARIANT (199): Lys, Ser, Ala, Thr, Gly, or Val
  MOD_RES (200): Hydroxyproline
  VARIANT (201): Lys, Ser, Ala, Thr, Gly, or Val
  MOD_RES (202): Hydroxyproline
  VARIANT (203): Lys, Ser, Ala, Thr, Gly, or Val
  MOD_RES (204): Hydroxyproline
  VARIANT (205): Lys, Ser, Ala, Thr, Gly, or Val
  MOD_RES (206): Hydroxyproline
  VARIANT (207): Lys, Ser, Ala, Thr, Gly, or Val
  MOD_RES (208): Hydroxyproline
  VARIANT (209): Lys, Ser, Ala, Thr, Gly, or Val
  MOD_RES (210): Hydroxyproline
  VARIANT (211): Lys, Ser, Ala, Thr, Gly, or Val
  MOD_RES (212): Hydroxyproline
  VARIANT (213): Lys, Ser, Ala, Thr, Gly, or Val
  MOD_RES (214): Hydroxyproline
  VARIANT (215): Lys, Ser, Ala, Thr, Gly, or Val
  MOD_RES (216): Hydroxyproline
  VARIANT (217): Lys, Ser, Ala, Thr, Gly, or Val
  MOD_RES (218): Hydroxyproline
  VARIANT (219): Lys, Ser, Ala, Thr, Gly, or Val
  MOD_RES (220): Hydroxyproline
  VARIANT (221): Lys, Ser, Ala, Thr, Gly, or Val
  MOD_RES (222): Hydroxyproline
  VARIANT (223): Lys, Ser, Ala, Thr, Gly, or Val
  MOD_RES (224): Hydroxyproline
  VARIANT (225): Lys, Ser, Ala, Thr, Gly, or Val
  MOD_RES (226): Hydroxyproline
  VARIANT (227): Lys, Ser, Ala, Thr, Gly, or Val
  MOD_RES (228): Hydroxyproline
  VARIANT (229): Lys, Ser, Ala, Thr, Gly, or Val
  MOD_RES (230): Hydroxyproline
  VARIANT (231): Lys, Ser, Ala, Thr, Gly, or Val
  MOD_RES (232): Hydroxyproline
  VARIANT (233): Lys, Ser, Ala, Thr, Gly, or Val
  MOD_RES (234): Hydroxyproline
  VARIANT (235): Lys, Ser, Ala, Thr, Gly, or Val
  MOD_RES (236): Hydroxyproline
  VARIANT (237): Lys, Ser, Ala, Thr, Gly, or Val
  MOD_RES (238): Hydroxyproline
  VARIANT (239): Lys, Ser, Ala, Thr, Gly, or Val
  MOD_RES (240): Hydroxyproline
  VARIANT (241): Lys, Ser, Ala, Thr, Gly, or Val
  MOD_RES (242): Hydroxyproline
  VARIANT (243): Lys, Ser, Ala, Thr, Gly, or Val
  MOD_RES (244): Hydroxyproline
  VARIANT (245): Lys, Ser, Ala, Thr, Gly, or Val
  MOD_RES (246): Hydroxyproline
  VARIANT (247): Lys, Ser, Ala, Thr, Gly, or Val
  MOD_RES (248): Hydroxyproline
  VARIANT (249): Lys, Ser, Ala, Thr, Gly, or Val
  MOD_RES (250): Hydroxyproline
  VARIANT (251): Lys, Ser, Ala, Thr, Gly, or Val
  MOD_RES (252): Hydroxyproline
  VARIANT (253): Lys, Ser, Ala, Thr, Gly, or Val
  MOD_RES (254): Hydroxyproline
  VARIANT (255): Lys, Ser, Ala, Thr, Gly, or Val
  MOD_RES (256): Hydroxyproline
  VARIANT (257): Lys, Ser, Ala, Thr, Gly, or Val
  MOD_RES (258): Hydroxyproline
  VARIANT (259): Lys, Ser, Ala, Thr, Gly, or Val
  MOD_RES (260): Hydroxyproline
  VARIANT (261): Lys, Ser, Ala, Thr, Gly, or Val
  MOD_RES (262): Hydroxyproline
  VARIANT (263): Lys, Ser, Ala, Thr, Gly, or Val
  MOD_RES (264): Hydroxyproline
  VARIANT (265): Lys, Ser, Ala, Thr, Gly, or Val
  MOD_RES (266): Hydroxyproline
  VARIANT (267): Lys, Ser, Ala, Thr, Gly, or Val
  MOD_RES (268): Hydroxyproline
  VARIANT (269): Lys, Ser, Ala, Thr, Gly, or Val
  MOD_RES (270): Hydroxyproline
  VARIANT (271): Lys, Ser, Ala, Thr, Gly, or Val
  MOD_RES (272): Hydroxyproline
  VARIANT (273): Lys, Ser, Ala, Thr, Gly, or Val
  MOD_RES (274): Hydroxyproline
  VARIANT (275): Lys, Ser, Ala, Thr, Gly, or Val
  MOD_RES (276): Hydroxyproline
  VARIANT (277): Lys, Ser, Ala, Thr, Gly, or Val
  MOD_RES (278): Hydroxyproline
  VARIANT (279): Lys, Ser, Ala, Thr, Gly, or Val
  MOD_RES (280): Hydroxyproline
  VARIANT (281): Lys, Ser, Ala, Thr, Gly, or Val
  MOD_RES (282): Hydroxyproline
  VARIANT (283): Lys, Ser, Ala, Thr, Gly, or Val
  MOD_RES (284): Hydroxyproline
  VARIANT (285): Lys, Ser, Ala, Thr, Gly, or Val
  MOD_RES (286): Hydroxyproline
  VARIANT (287): Lys, Ser, Ala, Thr, Gly, or Val
  MOD_RES (288): Hydroxyproline
  VARIANT (289): Lys, Ser, Ala, Thr, Gly, or Val
  MOD_RES (290): Hydroxyproline
  VARIANT (291): Lys, Ser, Ala, Thr, Gly, or Val
  MOD_RES (292): Hydroxyproline
  VARIANT (293): Lys, Ser, Ala, Thr, Gly, or Val
  MOD_RES (294): Hydroxyproline
  VARIANT (295): Lys, Ser, Ala, Thr, Gly, or Val
  MOD_RES (296): Hydroxyproline
  VARIANT (297): Lys, Ser, Ala, Thr, Gly, or Val
  MOD_RES (298): Hydroxyproline
  VARIANT (299): Lys, Ser, Ala, Thr, Gly, or Val
  MOD_RES (300): Hydroxyproline
  VARIANT (301): Lys, Ser, Ala, Thr, Gly, or Val
  MOD_RES (302): Hydroxyproline
  VARIANT (303): Lys, Ser, Ala, Thr, Gly, or Val
  MOD_RES (304): Hydroxyproline
  VARIANT (305): Lys, Ser, Ala, Thr, Gly, or Val
  MOD_RES (306): Hydroxyproline
  VARIANT (307): Lys, Ser, Ala, Thr, Gly, or Val
  MOD_RES (308): Hydroxyproline
  VARIANT (309): Lys, Ser, Ala, Thr, Gly, or Val
  MOD_RES (310): Hydroxyproline
  VARIANT (311): Lys, Ser, Ala, Thr, Gly, or Val
  MOD_RES (312): Hydroxyproline
  VARIANT (313): Lys, Ser, Ala, Thr, Gly, or Val
  MOD_RES (314): Hydroxyproline
  VARIANT (315): Lys, Ser, Ala, Thr, Gly, or Val
  MOD_RES (316): Hydroxyproline
  VARIANT (317): Lys, Ser, Ala, Thr, Gly, or Val
  MOD_RES (318): Hydroxyproline
  VARIANT (319): Lys, Ser, Ala, Thr, Gly, or Val
  MOD_RES (320): Hydroxyproline
  VARIANT (321): Lys, Ser, Ala, Thr, Gly, or Val
  MOD_RES (322): Hydroxyproline
  VARIANT (323): Lys, Ser, Ala, Thr, Gly, or Val
  MOD_RES (324): Hydroxyproline
  VARIANT (325): Lys, Ser, Ala, Thr, Gly, or Val
  MOD_RES (326): Hydroxyproline
  VARIANT (327): Lys, Ser, Ala, Thr, Gly, or Val
  MOD_RES (328): Hydroxyproline
  VARIANT (329): Lys, Ser, Ala, Thr, Gly, or Val
  MOD_RES (330): Hydroxyproline
  VARIANT (331): Lys, Ser, Ala, Thr, Gly, or Val
  MOD_RES (332): Hydroxyproline
  VARIANT (333): Lys, Ser, Ala, Thr, Gly, or Val
  MOD_RES (334): Hydroxyproline
  VARIANT (335): Lys, Ser, Ala, Thr, Gly, or Val
  MOD_RES (336): Hydroxyproline
  VARIANT (337): Lys, Ser, Ala, Thr, Gly, or Val
  MOD_RES (338): Hydroxyproline
  VARIANT (339): Lys, Ser, Ala, Thr, Gly, or Val
  MOD_RES (340): Hydroxyproline
  VARIANT (341): Lys, Ser, Ala, Thr, Gly, or Val
  MOD_RES (342): Hydroxyproline
  VARIANT (343): Lys, Ser, Ala, Thr, Gly, or Val
  MOD_RES (344): Hydroxyproline
  VARIANT (345): Lys, Ser, Ala, Thr, Gly, or Val
  MOD_RES (346): Hydroxyproline
  VARIANT (347): Lys, Ser, Ala, Thr, Gly, or Val
  MOD_RES (348): Hydroxyproline
  VARIANT (349): Lys, Ser, Ala, Thr, Gly, or Val
  MOD_RES (350): Hydroxyproline
  VARIANT (351): Lys, Ser, Ala, Thr, Gly, or Val
  MOD_RES (352): Hydroxyproline
  VARIANT (353): Lys, Ser, Ala, Thr, Gly, or Val
  MOD_RES (354): Hydroxyproline
  VARIANT (355): Lys, Ser, Ala, Thr, Gly, or Val
  MOD_RES (356): Hydroxyproline
  VARIANT (357): Lys, Ser, Ala, Thr, Gly, or Val
  MOD_RES (358): Hydroxyproline
  VARIANT (359): Lys, Ser, Ala, Thr, Gly, or Val
  MOD_RES (360): Hydroxyproline
  VARIANT (361): Lys, Ser, Ala, Thr, Gly, or Val
  MOD_RES (362): Hydroxyproline
  VARIANT (363): Lys, Ser, Ala, Thr, Gly, or Val
  MOD_RES (364): Hydroxyproline
  VARIANT (365): Lys, Ser, Ala, Thr, Gly, or Val
  MOD_RES (366): Hydroxyproline
  VARIANT (367): Lys, Ser, Ala, Thr, Gly, or Val
  MOD_RES (368): Hydroxyproline
  VARIANT (369): Lys, Ser, Ala, Thr, Gly, or Val
  MOD_RES (370): Hydroxyproline
  VARIANT (371): Lys, Ser, Ala, Thr, Gly, or Val
  MOD_RES (372): Hydroxyproline
  VARIANT (373): Lys, Ser, Ala, Thr, Gly, or Val
  MOD_RES (374): Hydroxyproline
  VARIANT (375): Lys, Ser, Ala, Thr, Gly, or Val
  MOD_RES (376): Hydroxyproline
  VARIANT (377): Lys, Ser, Ala, Thr, Gly, or Val
  MOD_RES (378): Hydroxyproline
  VARIANT (379): Lys, Ser, Ala, Thr, Gly, or Val
  MOD_RES (380): Hydroxyproline
  VARIANT (381): Lys, Ser, Ala, Thr, Gly, or Val
  MOD_RES (382): Hydroxyproline
  VARIANT (383): Lys, Ser, Ala, Thr, Gly, or Val
  MOD_RES (384): Hydroxyproline
  VARIANT (385): Lys, Ser, Ala, Thr, Gly, or Val
  MOD_RES (386): Hydroxyproline
  VARIANT (387): Lys, Ser, Ala, Thr, Gly, or Val
  MOD_RES (388): Hydroxyproline
  VARIANT (389): Lys, Ser, Ala, Thr, Gly, or Val
  MOD_RES (390): Hydroxyproline
  VARIANT (391): Lys, Ser, Ala, Thr, Gly, or Val
  MOD_RES (392): Hydroxyproline
  VARIANT (393): Lys, Ser, Ala, Thr, Gly, or Val
  MOD_RES (394): Hydroxyproline
  VARIANT (395): Lys, Ser, Ala, Thr, Gly, or Val
  MOD_RES (396): Hydroxyproline
  VARIANT (397): Lys, Ser, Ala, Thr, Gly, or Val
  MOD_RES (398): Hydroxyproline
  VARIANT (399): Lys, Ser, Ala, Thr, Gly, or Val
  MOD_RES (400): Hydroxyproline
  VARIANT (401): Lys, Ser, Ala, Thr, Gly, or Val
  MOD_RES (402): Hydroxyproline
  VARIANT (403): Lys, Ser, Ala, Thr, Gly, or Val
  MOD_RES (404): Hydroxyproline
  VARIANT (405): Lys, Ser, Ala, Thr, Gly, or Val
  MOD_RES (406): Hydroxyproline
  VARIANT (407): Lys, Ser, Ala, Thr, Gly, or Val
  MOD_RES (408): Hydroxyproline
  VARIANT (409): Lys, Ser, Ala, Thr, Gly, or Val
  MOD_RES (410): Hydroxyproline
  VARIANT (411): Lys, Ser, Ala, Thr, Gly, or Val
  MOD_RES (412): Hydroxyproline
  VARIANT (413): Lys, Ser, Ala, Thr, Gly, or Val
  MOD_RES (414): Hydroxyproline
  VARIANT (415): Lys, Ser, Ala, Thr, Gly, or Val
  MOD_RES (416): Hydroxyproline
  VARIANT (417): Lys, Ser, Ala, Thr, Gly, or Val
  MOD_RES (418): Hydroxyproline
  VARIANT (419): Lys, Ser, Ala, Thr, Gly, or Val
  MOD_RES (420): Hydroxyproline
  VARIANT (421): Lys, Ser, Ala, Thr, Gly, or Val
  MOD_RES (422): Hydroxyproline
  VARIANT (423): Lys, Ser, Ala, Thr, Gly, or Val
  MOD_RES (424): Hydroxyproline
  VARIANT (425): Lys, Ser, Ala, Thr, Gly, or Val
  MOD_RES (426): Hydroxyproline
  VARIANT (427): Lys, Ser, Ala, Thr, Gly, or Val
  MOD_RES (428): Hydroxyproline
  VARIANT (429): Lys, Ser, Ala, Thr, Gly, or Val
  MOD_RES (430): Hydroxyproline
  VARIANT (431): Lys, Ser, Ala, Thr, Gly, or Val
  MOD_RES (432): Hydroxyproline
  VARIANT (433): Lys, Ser, Ala, Thr, Gly, or Val
  MOD_RES (434): Hydroxyproline
  VARIANT (435): Lys, Ser, Ala, Thr, Gly, or Val
  MOD_RES (436): Hydroxyproline
  VARIANT (437): Lys, Ser, Ala, Thr, Gly, or Val
  MOD_RES (438): Hydroxyproline
  VARIANT (439): Lys, Ser, Ala, Thr, Gly, or Val
  MOD_RES (440): Hydroxyproline
  VARIANT (441): Lys, Ser, Ala, Thr, Gly, or Val
  MOD_RES (442): Hydroxyproline
  VARIANT (443): Lys, Ser, Ala, Thr, Gly, or Val
  MOD_RES (444): Hydroxyproline
  VARIANT (445): Lys, Ser, Ala, Thr, Gly, or Val
  MOD_RES (446): Hydroxyproline
  VARIANT (447): Lys, Ser, Ala, Thr, Gly, or Val
  MOD_RES (448): Hydroxyproline
  VARIANT (449): Lys, Ser, Ala, Thr, Gly, or Val
  MOD_RES (450): Hydroxyproline
  VARIANT (451): Lys, Ser, Ala, Thr, Gly, or Val
  MOD_RES (452): Hydroxyproline
  VARIANT (453): Lys, Ser, Ala, Thr, Gly, or Val
  MOD_RES (454): Hydroxyproline
  VARIANT (455): Lys, Ser, Ala, Thr, Gly, or Val
  MOD_RES (456): Hydroxyproline
  VARIANT (457): Lys, Ser, Ala, Thr, Gly, or Val
  MOD_RES (458): Hydroxyproline
  VARIANT (459): Lys, Ser, Ala, Thr, Gly, or Val
  MOD_RES (460): Hydroxyproline
  VARIANT (461): Lys, Ser, Ala, Thr, Gly, or Val
  MOD_RES (462): Hydroxyproline
  VARIANT (463): Lys, Ser, Ala, Thr, Gly, or Val
  MOD_RES (464): Hydroxyproline
  VARIANT (465): Lys, Ser, Ala, Thr, Gly, or Val
  MOD_RES (466): Hydroxyproline
  VARIANT (467): Lys, Ser, Ala, Thr, Gly, or Val
  MOD_RES (468): Hydroxyproline
  VARIANT (469): Lys, Ser, Ala, Thr, Gly, or Val
  MOD_RES (470): Hydroxyproline
  VARIANT (471): Lys, Ser, Ala, Thr, Gly, or Val
  MOD_RES (472): Hydroxyproline
  VARIANT (473): Lys, Ser, Ala, Thr, Gly, or Val
  MOD_RES (474): Hydroxyproline
  VARIANT (475): Lys, Ser, Ala, Thr, Gly, or Val
  MOD_RES (476): Hydroxyproline
  VARIANT (477): Lys, Ser, Ala, Thr, Gly, or Val
  MOD_RES (478): Hydroxyproline
  VARIANT (479): Lys, Ser, Ala, Thr, Gly, or Val
  MOD_RES (480): Hydroxyproline
  VARIANT (481): Lys, Ser, Ala, Thr, Gly, or Val
  MOD_RES (482): Hydroxyproline
  VARIANT (483): Lys, Ser, Ala, Thr, Gly, or Val
  MOD_RES (484): Hydroxyproline
  VARIANT (485): Lys, Ser, Ala, Thr, Gly, or Val
  MOD_RES (486): Hydroxyproline
  VARIANT (487): Lys, Ser, Ala, Thr, Gly, or Val
  MOD_RES (488): Hydroxyproline
  VARIANT (489): Lys, Ser, Ala, Thr, Gly, or Val
  MOD_RES (490): Hydroxyproline
  VARIANT (491): Lys, Ser, Ala, Thr, Gly, or Val
  MOD_RES (492): Hydroxyproline
  VARIANT (493): Lys, Ser, Ala, Thr, Gly, or Val
  MOD_RES (494): Hydroxyproline
  VARIANT (495): Lys, Ser, Ala, Thr, Gly, or Val
  MOD_RES (496): Hydroxyproline
  VARIANT (497): Lys, Ser, Ala, Thr, Gly, or Val
  MOD_RES (498): Hydroxyproline
  VARIANT (499): Lys, Ser, Ala, Thr, Gly, or Val
  MOD_RES (500): Hydroxyproline
  VARIANT (501): Lys, Ser, Ala, Thr, Gly, or Val
  MOD_RES (502): Hydroxyproline
  VARIANT (503): Lys, Ser, Ala, Thr, Gly, or Val
  MOD_RES (504): Hydroxyproline
  VARIANT (505): Lys, Ser, Ala, Thr, Gly, or Val
  MOD_RES (506): Hydroxyproline
  VARIANT (507): Lys, Ser, Ala, Thr, Gly, or Val
  MOD_RES (508): Hydroxyproline
  VARIANT (509): Lys, Ser, Ala, Thr, Gly, or Val
  MOD_RES (510): Hydroxyproline
  VARIANT (511): Lys, Ser, Ala, Thr, Gly, or Val
  MOD_RES (512): Hydroxyproline
  VARIANT (513): Lys, Ser, Ala, Thr, Gly, or Val
  MOD_RES (514): Hydroxyproline
  VARIANT (515): Lys, Ser, Ala, Thr, Gly, or Val
  MOD_RES (516): Hydroxyproline
  VARIANT (517): Lys, Ser, Ala, Thr, Gly, or Val
  MOD_RES (518): Hydroxyproline
  VARIANT (519): Lys, Ser, Ala, Thr, Gly, or Val
  MOD_RES (520): Hydroxyproline
  VARIANT (521): Lys, Ser, Ala, Thr, Gly, or Val
  MOD_RES (522): Hydroxyproline
  VARIANT (523): Lys, Ser, Ala, Thr, Gly, or Val
  MOD_RES (524): Hydroxyproline
  VARIANT (525): Lys, Ser, Ala, Thr, Gly, or Val
  MOD_RES (526): Hydroxyproline
  VARIANT (527): Lys, Ser, Ala, Thr, Gly, or Val
  MOD_RES (528): Hydroxyproline
  VARIANT (529): Lys, Ser, Ala, Thr, Gly, or Val
  MOD_RES (530): Hydroxyproline
  VARIANT (531): Lys, Ser, Ala, Thr, Gly, or Val
  MOD_RES (532): Hydroxyproline
  VARIANT (533): Lys, Ser, Ala, Thr, Gly, or Val
  MOD_RES (534): Hydroxyproline
  VARIANT (535): Lys, Ser, Ala, Thr, Gly, or Val
  MOD_RES (536): Hydroxyproline
  VARIANT (537): Lys, Ser, Ala, Thr, Gly, or Val
  MOD_RES (538): Hydroxyproline
  VARIANT (539): Lys, Ser, Ala, Thr, Gly, or Val
  MOD_RES (540): Hydroxyproline
  VARIANT (541): Lys, Ser, Ala, Thr, Gly, or Val
  MOD_RES (542): Hydroxyproline
  VARIANT (543): Lys, Ser, Ala, Thr, Gly, or Val
  MOD_RES (544): Hydroxyproline
  VARIANT (545): Lys, Ser, Ala, Thr, Gly, or Val
  MOD_RES (546): Hydroxyproline
  VARIANT (547): Lys, Ser, Ala, Thr, Gly, or Val
  MOD_RES (548): Hydroxyproline
  VARIANT (549): Lys, Ser, Ala, Thr, Gly, or Val
  MOD_RES (550): Hydroxyproline
  VARIANT (551): Lys, Ser, Ala, Thr, Gly, or Val
  MOD_RES (552): Hydroxyproline
  VARIANT (553): Lys, Ser, Ala, Thr, Gly, or Val
  MOD_RES (554): Hydroxyproline
  VARIANT (555): Lys, Ser, Ala, Thr, Gly, or Val
  MOD_RES (556): Hydroxyproline
  VARIANT (557): Lys, Ser, Ala, Thr, Gly, or Val
  MOD_RES (558): Hydroxyproline
  VARIANT (559): Lys, Ser, Ala, Thr, Gly, or Val
  MOD_RES (560): Hydroxyproline
  VARIANT (561): Lys, Ser, Ala, Thr, Gly, or Val
  MOD_RES (562): Hydroxyproline
  VARIANT (563): Lys, Ser, Ala, Thr, Gly, or Val
  MOD_RES (564): Hydroxyproline
  VARIANT (565): Lys, Ser, Ala, Thr, Gly, or Val
  MOD_RES (566): Hydroxyproline
  VARIANT (567): Lys, Ser, Ala, Thr, Gly, or Val
  MOD_RES (568): Hydroxyproline
  VARIANT (569): Lys, Ser, Ala, Thr, Gly, or Val
  MOD_RES (570): Hydroxyproline
  VARIANT (571): Lys, Ser, Ala, Thr, Gly, or Val
  MOD_RES (572): Hydroxyproline
  VARIANT (573): Lys, Ser, Ala, Thr, Gly, or Val
  MOD_RES (574): Hydroxyproline
  VARIANT (575): Lys, Ser, Ala, Thr, Gly, or Val
  MOD_RES (576): Hydroxyproline
  VARIANT (577): Lys, Ser, Ala, Thr, Gly, or Val
  MOD_RES (578): Hydroxyproline
  VARIANT (579): Lys, Ser, Ala, Thr, Gly, or Val
  MOD_RES (580): Hydroxyproline
  VARIANT (581): Lys, Ser, Ala, Thr, Gly, or Val
  MOD_RES (582): Hydroxyproline
  VARIANT (583): Lys, Ser, Ala, Thr, Gly, or Val
  MOD_RES (584): Hydroxyproline
  VARIANT (585): Lys, Ser, Ala, Thr, Gly, or Val
  MOD_RES (586): Hydroxyproline
  VARIANT (587): Lys, Ser, Ala, Thr, Gly, or Val
  MOD_RES (588): Hydroxyproline
  VARIANT (589): Lys, Ser, Ala, Thr, Gly, or Val
  MOD_RES (590): Hydroxyproline
  VARIANT (591): Lys, Ser, Ala, Thr, Gly, or Val
  MOD_RES (592): Hydroxyproline
  VARIANT (593): Lys, Ser, Ala, Thr, Gly, or Val
  MOD_RES (594): Hydroxyproline
  VARIANT (595): Lys, Ser, Ala, Thr, Gly, or Val
  MOD_RES (596): Hydroxyproline
  VARIANT (597): Lys, Ser, Ala, Thr, Gly, or Val
  MOD_RES (598): Hydroxyproline
  VARIANT (599): Lys, Ser, Ala, Thr, Gly, or Val
  MOD_RES (600): Hydroxyproline
  VARIANT (601): Lys, Ser, Ala, Thr, Gly, or Val
  MOD_RES (602): Hydroxyproline
  VARIANT (603): Lys, Ser, Ala, Thr, Gly, or Val
  MOD_RES (604): Hydroxyproline
  VARIANT (605): Lys, Ser, Ala, Thr, Gly, or Val
  MOD_RES (606): Hydroxyproline
  VARIANT (607): Lys, Ser, Ala, Thr, Gly, or Val
  MOD_RES (608): Hydroxyproline
  VARIANT (609): Lys, Ser, Ala, Thr, Gly, or Val
  MOD_RES (610): Hydroxyproline
  VARIANT (611): Lys, Ser, Ala, Thr, Gly, or Val
  MOD_RES (612): Hydroxyproline
  VARIANT (613): Lys, Ser, Ala, Thr, Gly, or Val
  MOD_RES (614): Hydroxyproline
  VARIANT (615): Lys, Ser, Ala, Thr, Gly, or Val
  MOD_RES (616): Hydroxyproline
  VARIANT (617): Lys, Ser, Ala, Thr, Gly, or Val
  MOD_RES (618): Hydroxyproline
  VARIANT (619): Lys, Ser, Ala, Thr, Gly, or Val
  MOD_RES (620): Hydroxyproline
  VARIANT (621): Lys, Ser, Ala, Thr, Gly, or Val
  MOD_RES (622): Hydroxyproline
  VARIANT (623): Lys, Ser, Ala, Thr, Gly, or Val
  MOD_RES (624): Hydroxyproline
  VARIANT (625): Lys, Ser, Ala, Thr, Gly, or Val
  MOD_RES (626): Hydroxyproline
  VARIANT (627): Lys, Ser, Ala, Thr, Gly, or Val
  MOD_RES (628): Hydroxyproline
  VARIANT (629): Lys, Ser, Ala, Thr, Gly, or Val
  MOD_RES (630): Hydroxyproline
  VARIANT (631): Lys, Ser, Ala, Thr, Gly, or Val
  MOD_RES (632): Hydroxyproline
  VARIANT (633): Lys, Ser, Ala, Thr, Gly, or Val
  MOD_RES (634): Hydroxyproline
  VARIANT (635): Lys, Ser, Ala, Thr, Gly, or Val
  MOD_RES (636): Hydroxyproline
  VARIANT (637): Lys, Ser, Ala, Thr, Gly, or Val
  MOD_RES (638): Hydroxyproline
  VARIANT (639): Lys, Ser, Ala, Thr, Gly, or Val
  MOD_RES (640): Hydroxyproline
  VARIANT (641): Lys, Ser, Ala, Thr, Gly, or Val
  MOD_RES (642): Hydroxyproline
  VARIANT (643): Lys, Ser, Ala, Thr, Gly, or Val
  MOD_RES (644): Hydroxyproline
  VARIANT (645): Lys, Ser, Ala, Thr, Gly, or Val
  MOD_RES (646): Hydroxyproline
  VARIANT (647): Lys, Ser, Ala, Thr, Gly, or Val
  MOD_RES (648): Hydroxyproline
  VARIANT (649): Lys, Ser, Ala, Thr, Gly, or Val
  MOD_RES (650): Hydroxyproline
  VARIANT (651): Lys, Ser, Ala, Thr, Gly, or Val
  MOD_RES (652): Hydroxyproline
  VARIANT (653): Lys, Ser, Ala, Thr, Gly, or Val
  MOD_RES (654): Hydroxyproline
  VARIANT (655): Lys, Ser, Ala, Thr, Gly, or Val
  MOD_RES (656): Hydroxyproline
  VARIANT (657): Lys, Ser, Ala, Thr, Gly, or Val
  MOD_RES (658): Hydroxyproline
  VARIANT (659): Lys, Ser, Ala, Thr, Gly, or Val
  MOD_RES (660): Hydroxyproline
  VARIANT (661): Lys, Ser, Ala, Thr, Gly, or Val
  MOD_RES (662): Hydroxyproline
  VARIANT (663): Lys, Ser, Ala, Thr, Gly, or Val
  MOD_RES (664): Hydroxyproline
  VARIANT (665): Lys, Ser, Ala, Thr, Gly, or Val
  MOD_RES (666): Hydroxyproline
  VARIANT (667): Lys, Ser, Ala, Thr, Gly, or Val
  MOD_RES (668): Hydroxyproline
  VARIANT (669): Lys, Ser, Ala, Thr, Gly, or Val
  MOD_RES (670): Hydroxyproline
  VARIANT (671): Lys, Ser, Ala, Thr, Gly, or Val
  MOD_RES (672): Hydroxyproline
  VARIANT (673): Lys, Ser, Ala, Thr, Gly, or Val
  MOD_RES (674): Hydroxyproline
  VARIANT (675): Lys, Ser, Ala, Thr, Gly, or Val
  MOD_RES (676): Hydroxyproline
  VARIANT (677): Lys, Ser, Ala, Thr, Gly, or Val
  MOD_RES (678): Hydroxyproline
  VARIANT (679): Lys, Ser, Ala, Thr, Gly, or Val
  MOD_RES (680): Hydroxyproline
  VARIANT (681): Lys, Ser, Ala, Thr, Gly, or Val
  MOD_RES (682): Hydroxyproline
  VARIANT (683): Lys, Ser, Ala, Thr, Gly, or Val
  MOD_RES (684): Hydroxyproline
  VARIANT (685): Lys, Ser, Ala, Thr, Gly, or Val
  MOD_RES (686): Hydroxyproline
  VARIANT (687): Lys, Ser, Ala, Thr, Gly, or Val
  MOD_RES (688): Hydroxyproline
  VARIANT (689): Lys, Ser, Ala, Thr, Gly, or Val
  MOD_RES (690): Hydroxyproline
  VARIANT (691): Lys, Ser, Ala, Thr, Gly, or Val
  MOD_RES (692): Hydroxyproline
  VARIANT (693): Lys, Ser, Ala, Thr, Gly, or Val
  MOD_RES (694): Hydroxyproline
  VARIANT (695): Lys, Ser, Ala, Thr, Gly, or Val
  MOD_RES (696): Hydroxyproline
  VARIANT (697): Lys, Ser, Ala, Thr, Gly, or Val
  MOD_RES (698): Hydroxyproline
  VARIANT (699): Lys, Ser, Ala, Thr, Gly, or Val
  MOD_RES (700): Hydroxyproline
  VARIANT (701): Lys, Ser, Ala, Thr, Gly, or Val
  MOD_RES (702): Hydroxyproline
  VARIANT (703): Lys, Ser, Ala, Thr, Gly, or Val
  MOD_RES (704): Hydroxyproline
  VARIANT (705): Lys, Ser, Ala, Thr, Gly, or Val
  MOD_RES (706): Hydroxyproline
  VARIANT (707): Lys, Ser, Ala, Thr, Gly, or Val
  MOD_RES (708): Hydroxyproline
  VARIANT (709): Lys, Ser, Ala, Thr, Gly, or Val
  MOD_RES (710): Hydroxyproline
  VARIANT (711): Lys, Ser, Ala, Thr, Gly, or Val
  MOD_RES (712): Hydroxyproline
  VARIANT (713): Lys, Ser, Ala, Thr, Gly, or Val
  MOD_RES (714): Hydroxyproline
  VARIANT (715): Lys, Ser, Ala, Thr, Gly, or Val
  MOD_RES (716): Hydroxyproline
  VARIANT (717): Lys, Ser, Ala, Thr, Gly, or Val
  MOD_RES (718): Hydroxyproline
  VARIANT (719): Lys, Ser, Ala, Thr, Gly, or Val
  MOD_RES (720): Hydroxyproline
  VARIANT (721): Lys, Ser, Ala, Thr, Gly, or Val
  MOD_RES (722): Hydroxyproline
  VARIANT (723): Lys, Ser, Ala, Thr, Gly, or Val
  MOD_RES (724): Hydroxyproline
  VARIANT (725): Lys, Ser, Ala, Thr, Gly, or Val
  MOD_RES (726): Hydroxyproline
  VARIANT (727): Lys, Ser, Ala, Thr, Gly, or Val
  MOD_RES (728): Hydroxyproline
  VARIANT (729): Lys, Ser, Ala, Thr, Gly, or Val
  MOD_RES (730): Hydroxyproline
  VARIANT (731): Lys, Ser, Ala, Thr, Gly, or Val
  MOD_RES (732): Hydroxyproline
  VARIANT (733): Lys, Ser, Ala, Thr, Gly, or Val
  MOD_RES (734): Hydroxyproline
  VARIANT (735): Lys, Ser, Ala, Thr, Gly, or Val
  MOD_RES (736): Hydroxyproline
  VARIANT (737): Lys, Ser, Ala, Thr, Gly, or Val
  MOD_RES (738): Hydroxyproline
  VARIANT (739): Lys, Ser, Ala, Thr, Gly, or Val
  MOD_RES (740): Hydroxyproline
  VARIANT (741): Lys, Ser, Ala, Thr, Gly, or Val
  MOD_RES (742): Hydroxyproline
  VARIANT (743): Lys, Ser, Ala, Thr, Gly, or Val
  MOD_RES (744): Hydroxyproline
  VARIANT (745): Lys, Ser, Ala, Thr, Gly, or Val
  MOD_RES (746): Hydroxyproline
  VARIANT (747): Lys, Ser, Ala, Thr, Gly, or Val
  MOD_RES (748): Hydroxyproline
  VARIANT (749): Lys, Ser, Ala, Thr, Gly, or Val
  MOD_RES (750): Hydroxyproline
  VARIANT (751): Lys, Ser, Ala, Thr, Gly, or Val
  MOD_RES (752): Hydroxyproline
  VARIANT (753): Lys, Ser, Ala, Thr, Gly, or Val
  MOD_RES (754): Hydroxyproline
  VARIANT (755): Lys, Ser, Ala, Thr, Gly, or Val
  MOD_RES (756): Hydroxyproline
  VARIANT (757): Lys, Ser, Ala, Thr, Gly, or Val
  MOD_RES (758): Hydroxyproline
  VARIANT (759): Lys, Ser, Ala, Thr, Gly, or Val
  MOD_RES (760): Hydroxyproline
  VARIANT (761): Lys, Ser, Ala, Thr, Gly, or Val
  MOD_RES (762): Hydroxyproline
  VARIANT (763): Lys, Ser, Ala, Thr, Gly, or Val
  MOD_RES (764): Hydroxyproline
  VARIANT (765): Lys, Ser, Ala, Thr, Gly, or Val
  MOD_RES (766): Hydroxyproline
  VARIANT (767): Lys, Ser, Ala, Thr, Gly, or Val
  MOD_RES (768): Hydroxyproline
  VARIANT (769): Lys, Ser, Ala, Thr, Gly, or Val
  MOD_RES (770): Hydroxyproline
  VARIANT (771): Lys, Ser, Ala, Thr, Gly, or Val
  MOD_RES (772): Hydroxyproline
  VARIANT (773): Lys, Ser, Ala, Thr, Gly, or Val
  MOD_RES (774): Hydroxyproline
  VARIANT (775): Lys, Ser, Ala, Thr, Gly, or Val
  MOD_RES (776): Hydroxyproline
  VARIANT (777): Lys, Ser, Ala, Thr, Gly, or Val
  MOD_RES (778): Hydroxyproline
  VARIANT (779): Lys, Ser, Ala, Thr, Gly, or Val
  MOD_RES (780): Hydroxyproline
  VARIANT (781): Lys, Ser, Ala, Thr, Gly, or Val
  MOD_RES (782): Hydroxyproline
  VARIANT (783): Lys, Ser, Ala, Thr, Gly, or Val
  MOD_RES (784): Hydroxyproline
  VARIANT (785): Lys, Ser, Ala, Thr, Gly, or Val
  MOD_RES (786): Hydroxyproline
  VARIANT (787): Lys, Ser, Ala, Thr, Gly, or Val
  MOD_RES (788): Hydroxyproline
  VARIANT (789): Lys, Ser, Ala, Thr, Gly, or Val
  MOD_RES (790): Hydroxyproline
  VARIANT (791): Lys, Ser, Ala, Thr, Gly, or Val
  MOD_RES (792): Hydroxyproline
  VARIANT (793): Lys, Ser, Ala, Thr, Gly, or Val
  MOD_RES (794): Hydroxyproline
  VARIANT (795): Lys, Ser, Ala, Thr, Gly, or Val
  MOD_RES (796): Hydroxyproline
  VARIANT (797): Lys, Ser, Ala, Thr, Gly, or Val
  MOD_RES (798): Hydroxyproline
  VARIANT (799): Lys, Ser, Ala, Thr, Gly, or Val
  MOD_RES (800): Hydroxyproline
  VARIANT (801): Lys, Ser, Ala, Thr, Gly, or Val
  MOD_RES (802): Hydroxyproline
  VARIANT (803): Lys, Ser, Ala, Thr, Gly, or Val
  MOD_RES (804): Hydroxyproline
  VARIANT (805): Lys, Ser, Ala, Thr, Gly, or Val
  MOD_RES (806): Hydroxyproline
  VARIANT (807): Lys, Ser, Ala, Thr, Gly, or Val
  MOD_RES (808): Hydroxyproline
  VARIANT (809): Lys, Ser, Ala, Thr, Gly, or Val
  MOD_RES (810): Hydroxyproline
  VARIANT (811): Lys, Ser, Ala, Thr, Gly, or Val
  MOD_RES (812): Hydroxyproline
  VARIANT (813): Lys, Ser, Ala, Thr, Gly, or Val
  MOD_RES (814): Hydroxyproline
  VARIANT (815): Lys, Ser, Ala, Thr, Gly, or Val
  MOD_RES (816): Hydroxyproline
  VARIANT (817): Lys, Ser, Ala, Thr, Gly, or Val
  MOD_RES (818): Hydroxyproline
  VARIANT (819): Lys, Ser, Ala, Thr, Gly, or Val
  MOD_RES (820): Hydroxyproline
  VARIANT (821): Lys, Ser, Ala, Thr, Gly, or Val
  MOD_RES (822): Hydroxyproline
  VARIANT (823): Lys, Ser, Ala, Thr, Gly, or Val
  MOD_RES (824): Hydroxyproline
  VARIANT (825): Lys, Ser, Ala, Thr, Gly, or Val
  MOD_RES (826): Hydroxyproline
  VARIANT (827): Lys, Ser, Ala, Thr, Gly, or Val
  MOD_RES (828): Hydroxyproline
  VARIANT (829): Lys, Ser, Ala, Thr, Gly, or Val
  MOD_RES (830): Hydroxyproline
  VARIANT (831): Lys, Ser, Ala, Thr, Gly, or Val
  MOD_RES (832): Hydroxyproline
  VARIANT (833): Lys, Ser, Ala, Thr, Gly, or Val
  MOD_RES (834): Hydroxyproline
  VARIANT (835): Lys, Ser, Ala, Thr, Gly, or Val
  MOD_RES (836): Hydroxyproline
  VARIANT (837): Lys, Ser, Ala, Thr, Gly, or Val
  MOD_RES (838): Hydroxyproline
  VARIANT (839): Lys, Ser, Ala, Thr, Gly, or Val
  MOD_RES (840): Hydroxyproline
  VARIANT (841): Lys, Ser, Ala, Thr, Gly, or Val
  MOD_RES (842): Hydroxyproline
  VARIANT (843): Lys, Ser, Ala, Thr, Gly, or Val
  MOD_RES (844): Hydroxyproline
  VARIANT (845): Lys, Ser, Ala, Thr, Gly, or Val
  MOD_RES (846): Hydroxyproline
  VARIANT (847): Lys, Ser, Ala, Thr, Gly, or Val
  MOD_RES (848): Hydroxyproline
  VARIANT (849): Lys, Ser, Ala, Thr, Gly, or Val
  MOD_RES (850): Hydroxyproline
  VARIANT (851): Lys, Ser, Ala, Thr, Gly, or Val
  MOD_RES (852): Hydroxyproline
  VARIANT (853): Lys, Ser, Ala, Thr, Gly, or Val
  MOD_RES (854): Hydroxyproline
  VARIANT (855): Lys, Ser, Ala, Thr, Gly, or Val
  MOD_RES (856): Hydroxyproline
  VARIANT (857): Lys, Ser, Ala, Thr, Gly, or Val
  MOD_RES (858): Hydroxyproline
  VARIANT (859): Lys, Ser, Ala, Thr, Gly, or Val
  MOD_RES (860): Hydroxyproline
  VARIANT (861): Lys, Ser, Ala, Thr, Gly, or Val
  MOD_RES (862): Hydroxyproline
  VARIANT (863): Lys, Ser, Ala, Thr, Gly, or Val
  MOD_RES (864): Hydroxyproline
  VARIANT (865): Lys, Ser, Ala, Thr, Gly, or Val
  MOD_RES (866): Hydroxyproline
  VARIANT (867): Lys, Ser, Ala, Thr, Gly, or Val
  MOD_RES (868): Hydroxyproline
  VARIANT (869): Lys, Ser, Ala, Thr, Gly, or Val
  MOD_RES (870): Hydroxyproline
  VARIANT (871): Lys, Ser, Ala, Thr, Gly, or Val
  MOD_RES (872): Hydroxyproline
  VARIANT (873): Lys, Ser, Ala, Thr, Gly, or Val
  MOD_RES (874): Hydroxyproline
  VARIANT (875): Lys, Ser, Ala, Thr, Gly, or Val
  MOD_RES (876): Hydroxyproline
  VARIANT (877): Lys, Ser, Ala, Thr, Gly, or Val
  MOD_RES (878): Hydroxyproline
  VARIANT (879): Lys, Ser, Ala, Thr, Gly, or Val
  MOD_RES (880): Hydroxyproline
  VARIANT (881): Lys, Ser, Ala, Thr, Gly, or Val
  MOD_RES (882): Hydroxyproline
  VARIANT (883): Lys, Ser, Ala, Thr, Gly, or Val
  MOD_RES (884): Hydroxyproline
  VARIANT (885): Lys, Ser, Ala, Thr, Gly, or Val
  MOD_RES (886): Hydroxyproline
  VARIANT (887): Lys, Ser, Ala, Thr, Gly, or Val
  MOD_RES (888): Hydroxyproline
  VARIANT (889): Lys, Ser, Ala, Thr, Gly, or Val
  MOD_RES (890): Hydroxyproline
  VARIANT (891): Lys, Ser, Ala, Thr, Gly, or Val
  MOD_RES (892): Hydroxyproline
  VARIANT (893): Lys, Ser, Ala, Thr, Gly, or Val
  MOD_RES (894): Hydroxyproline
  VARIANT (895): Lys, Ser, Ala, Thr, Gly, or Val
  MOD_RES (896): Hydroxyproline
  VARIANT (897): Lys, Ser, Ala, Thr, Gly, or Val
  MOD_RES (898): Hydroxyproline
  VARIANT (899): Lys, Ser, Ala, Thr, Gly, or Val
  MOD_RES (900): Hydroxyproline
  VARIANT (901): Lys, Ser, Ala, Thr, Gly, or Val
  MOD_RES (902): Hydroxyproline
  VARIANT (903): Lys, Ser, Ala, Thr, Gly, or Val
  MOD_RES (904): Hydroxyproline
  VARIANT (905): Lys, Ser, Ala, Thr, Gly, or Val
  MOD_RES (906): Hydroxyproline
  VARIANT (907): Lys, Ser, Ala, Thr, Gly, or Val
  MOD_RES (908): Hydroxyproline
  VARIANT (909): Lys, Ser, Ala, Thr, Gly, or Val
  MOD_RES (910): Hydroxyproline
  VARIANT (911): Lys, Ser, Ala, Thr, Gly, or Val
  MOD_RES (912): Hydroxyproline
  VARIANT (913): Lys, Ser, Ala, Thr, Gly, or Val
  MOD_RES (914): Hydroxyproline
  VARIANT (915): Lys, Ser, Ala, Thr, Gly, or Val
  MOD_RES (916): Hydroxyproline
  VARIANT (917): Lys, Ser, Ala, Thr, Gly, or Val
  MOD_RES (918): Hydroxyproline
  VARIANT (919): Lys, Ser, Ala, Thr, Gly, or Val
  MOD_RES (920): Hydroxyproline
  VARIANT (921): Lys, Ser, Ala, Thr, Gly, or Val
  MOD_RES (922): Hydroxyproline
  VARIANT (923): Lys, Ser, Ala, Thr, Gly, or Val
  MOD_RES (924): Hydroxyproline
  VARIANT (925): Lys, Ser, Ala, Thr, Gly, or Val
  MOD_RES (926): Hydroxyproline
  VARIANT (927): Lys, Ser, Ala, Thr, Gly, or Val
  MOD_RES (928): Hydroxyproline
  VARIANT (929): Lys, Ser, Ala, Thr, Gly, or Val
  MOD_RES (930): Hydroxyproline
  VARIANT (931): Lys, Ser, Ala, Thr, Gly, or Val
  MOD_RES (932): Hydroxyproline
  VARIANT (933): Lys, Ser, Ala, Thr, Gly, or Val
  MOD_RES (934): Hydroxyproline
  VARIANT (935): Lys, Ser, Ala, Thr, Gly, or Val
  MOD_RES (936): Hydroxyproline
  VARIANT (937): Lys, Ser, Ala, Thr, Gly, or Val
  MOD_RES (938): Hydroxyproline
  VARIANT (939): Lys, Ser, Ala, Thr, Gly, or Val
  MOD_RES (940): Hydroxyproline
  VARIANT (941): Lys, Ser, Ala, Thr, Gly, or Val
  MOD_RES (942): Hydroxyproline
  VARIANT (943): Lys, Ser, Ala, Thr, Gly, or Val
  MOD_RES (944): Hydroxyproline
  VARIANT (945): Lys, Ser, Ala, Thr, Gly, or Val
  MOD_RES (946): Hydroxyproline
  VARIANT (947): Lys, Ser, Ala, Thr, Gly, or Val
  MOD_RES (948): Hydroxyproline
  VARIANT (949): Lys, Ser, Ala, Thr, Gly, or Val
  MOD_RES (950): Hydroxyproline
  VARIANT (951): Lys, Ser, Ala, Thr, Gly, or Val
  MOD_RES (952): Hydroxyproline
  VARIANT (953): Lys, Ser, Ala, Thr, Gly, or Val
  MOD_RES (954): Hydroxyproline
  VARIANT (955): Lys, Ser, Ala, Thr, Gly, or Val
  MOD_RES (956): Hydroxyproline
  VARIANT (957): Lys, Ser, Ala, Thr, Gly, or Val
  MOD_RES (958): Hydroxyproline
  VARIANT (959): Lys, Ser, Ala, Thr, Gly, or Val
  MOD_RES (960): Hydroxyproline
  VARIANT (961): Lys, Ser, Ala, Thr, Gly, or Val
  MOD_RES (962): Hydroxyproline
  VARIANT (963): Lys, Ser, Ala, Thr, Gly, or Val
  MOD_RES (964): Hydroxyproline
  VARIANT (965): Lys, Ser, Ala, Thr, Gly, or Val
  MOD_RES (966): Hydroxyproline
  VARIANT (967): Lys, Ser, Ala, Thr, Gly, or Val
  MOD_RES (968): Hydroxyproline
  VARIANT (969): Lys, Ser, Ala, Thr, Gly, or Val
  MOD_RES (970): Hydroxyproline
  VARIANT (971): Lys, Ser, Ala, Thr, Gly, or Val
  MOD_RES (972): Hydroxyproline
  VARIANT (973): Lys, Ser, Ala, Thr, Gly, or Val
  MOD_RES (974): Hydroxyproline
  VARIANT (975): Lys, Ser, Ala, Thr, Gly, or Val
  MOD_RES (976): Hydroxyproline
  VARIANT (977): Lys, Ser, Ala, Thr, Gly, or Val
  MOD_RES (978): Hydroxyproline
  VARIANT (979): Lys, Ser, Ala, Thr, Gly, or Val
  MOD_RES (980): Hydroxyproline
  VARIANT (981): Lys, Ser, Ala, Thr, Gly, or Val
  MOD_RES (982): Hydroxyproline
  VARIANT (983): Lys, Ser, Ala, Thr, Gly, or Val
  MOD_RES (984): Hydroxyproline
  VARIANT (985): Lys, Ser, Ala, Thr, Gly, or Val
  MOD_RES (986): Hydroxyproline
  VARIANT (987): Lys, Ser, Ala, Thr, Gly, or Val
  MOD_RES (988): Hydroxyproline
  VARIANT (989): Lys, Ser, Ala, Thr, Gly, or Val
  MOD_RES (990): Hydroxyproline
  VARIANT (991): Lys, Ser, Ala, Thr, Gly, or Val
  MOD_RES (992): Hydroxyproline
  VARIANT (993): Lys, Ser, Ala, Thr, Gly, or Val
  MOD_RES (994): Hydroxyproline
  VARIANT (995): Lys, Ser, Ala, Thr, Gly, or Val
  MOD_RES (996): Hydroxyproline
  VARIANT (997): Lys, Ser, Ala, Thr, Gly, or Val
  MOD_RES (998): Hydroxyproline
  VARIANT (999): Lys, Ser, Ala, Thr, Gly, or Val
  MOD_RES (1000): Hydroxyproline
  VARIANT (1001): Lys, Ser, Ala, Thr, Gly, or Val
  MOD_RES (1002): Hydroxyproline
  VARIANT (1003): Lys, Ser, Ala, Thr, Gly, or Val
  MOD_RES (1004): Hydroxyproline
  VARIANT (1005): Lys, Ser, Ala, Thr, Gly, or Val
  MOD_RES (1006): Hydroxyproline
  VARIANT (1007): Lys, Ser, Ala, Thr, Gly, or Val
  MOD_RES (1008): Hydroxyproline
  VARIANT (1009): Lys, Ser, Ala, Thr, Gly, or Val
  MOD_RES (1010): Hydroxyproline
  VARIANT (1011): Lys, Ser, Ala, Thr, Gly, or Val
  MOD_RES (1012): Hydroxyproline
  VARIANT (1013): Lys, Ser, Ala, Thr, Gly, or Val
  MOD_RES (1014): Hydroxyproline
  VARIANT (1015): Lys, Ser, Ala, Thr, Gly, or Val
  MOD_RES (1016): Hydroxyproline
  VARIANT (1017): Lys, Ser, Ala, Thr, Gly, or Val
  MOD_RES (1018): Hydroxyproline
  VARIANT (1019): Lys, Ser, Ala, Thr, Gly, or Val
  MOD_RES (1020): Hydroxyproline
  VARIANT (1021): Lys, Ser, Ala, Thr, Gly, or Val
  MOD_RES (1022): Hydroxyproline
  VARIANT (1023): Lys, Ser, Ala, Thr, Gly, or Val
  MOD_RES (1024): Hydroxyproline
  VARIANT (1025): Lys, Ser, Ala, Thr, Gly, or Val
  MOD_RES (1026): Hydroxyproline
  VARIANT (1027): Lys, Ser, Ala, Thr, Gly, or Val
  MOD_RES (1028): Hydroxyproline
  VARIANT (1029): Lys, Ser, Ala, Thr, Gly, or Val
  MOD_RES (1030): Hydroxyproline
  VARIANT (1031): Lys, Ser, Ala, Thr, Gly, or Val
  MOD_RES (1032): Hydroxyproline
  VARIANT (1033): Lys, Ser, Ala, Thr, Gly, or Val
  MOD_RES (1034): Hydroxyproline
  VARIANT (1035): Lys, Ser, Ala, Thr, Gly, or Val
  MOD_RES (1036): Hydroxyproline
  VARIANT (1037): Lys, Ser, Ala, Thr, Gly, or Val
  MOD_RES (1038): Hydroxyproline
  VARIANT (1039): Lys, Ser, Ala, Thr, Gly, or Val
  MOD_RES (1040): Hydroxyproline
  VARIANT (1041): Lys, Ser, Ala, Thr, Gly, or Val
  MOD_RES (1042): Hydroxyproline
  VARIANT (1043): Lys, Ser, Ala, Thr, Gly, or Val
  MOD_RES (1044): Hydroxyproline
  VARIANT (1045): Lys, Ser, Ala, Thr, Gly, or Val
  MOD_RES (1046): Hydroxyproline
  VARIANT (1047): Lys, Ser, Ala, Thr, Gly, or Val
  MOD_RES (1048): Hydroxyproline
  VARIANT (1049): Lys, Ser, Ala, Thr, Gly, or Val
  MOD_RES (1050): Hydroxyproline
  VARIANT (1051): Lys, Ser, Ala, Thr, Gly, or Val
  MOD_RES (1052): Hydroxyproline
  VARIANT (1053): Lys, Ser, Ala, Thr, Gly, or Val
  MOD_RES (1054): Hydroxyproline
  VARIANT (1055): Lys, Ser, Ala, Thr, Gly, or Val
  MOD_RES (1056): Hydroxyproline
  VARIANT (1057): Lys, Ser, Ala, Thr, Gly, or Val
  MOD_RES (1058): Hydroxyproline
  VARIANT (1059): Lys, Ser, Ala, Thr, Gly, or Val
  MOD_RES (1060): Hydroxyproline
  VARIANT (1061): Lys, Ser, Ala, Thr, Gly, or Val
  MOD_RES (1062): Hydroxyproline
  VARIANT (1063): Lys, Ser, Ala, Thr, Gly, or Val
  MOD_RES (1064): Hydroxyproline
  VARIANT (1065): Lys, Ser, Ala, Thr, Gly, or Val
  MOD_RES (1066): Hydroxyproline
  VARIANT (1067): Lys, Ser, Ala, Thr, Gly, or Val
  MOD_RES (1068): Hydroxyproline
  VARIANT (1069): Lys, Ser, Ala, Thr, Gly, or Val
  MOD_RES (1070): Hydroxyproline
  VARIANT (1071): Lys, Ser, Ala, Thr, Gly, or Val
  MOD_RES (1072): Hydroxyproline
  VARIANT (1073): Lys, Ser, Ala, Thr, Gly, or Val
  MOD_RES (1074): Hydroxyproline
  VARIANT (1075): Lys, Ser, Ala, Thr, Gly, or Val
  MOD_RES (1076): Hydroxyproline
  VARIANT (1077): Lys, Ser, Ala, Thr, Gly, or Val
  MOD_RES (1078): Hydroxyproline
  VARIANT (1079): Lys, Ser, Ala, Thr, Gly, or Val
  MOD_RES (1080): Hydroxyproline
  VARIANT (1081): Lys, Ser, Ala, Thr, Gly, or Val
  MOD_RES (1082): Hydroxyproline
  VARIANT (1083): Lys, Ser, Ala, Thr, Gly, or Val
  MOD_RES (1084): Hydroxyproline
  VARIANT (1085): Lys, Ser, Ala, Thr, Gly, or Val
  MOD_RES (1086): Hydroxyproline
  VARIANT (1087): Lys, Ser, Ala, Thr, Gly, or Val
  MOD_RES (1088): Hydroxyproline
  VARIANT (1089): Lys, Ser, Ala, Thr, Gly, or Val
  MOD_RES (1090): Hydroxyproline
  VARIANT (1091): Lys, Ser, Ala, Thr, Gly, or Val
  MOD_RES (1092): Hydroxyproline
  VARIANT (1093): Lys, Ser, Ala, Thr, Gly, or Val
  MOD_RES (1094): Hydroxyproline
  VARIANT (1095): Lys, Ser, Ala, Thr, Gly, or Val
  MOD_RES (1096): Hydroxyproline
  VARIANT (1097): Lys, Ser, Ala, Thr, Gly, or Val
  MOD_RES (1098): Hydroxyproline
  VARIANT (1099): Lys, Ser, Ala, Thr, Gly, or Val
  MOD_RES (1100): Hydroxyproline
  VARIANT (1101): Lys, Ser, Ala, Thr, Gly, or Val
  MOD_RES (1102): Hydroxyproline
  VARIANT (1103): Lys, Ser, Ala, Thr, Gly, or Val
  MOD_RES (1104): Hydroxyproline
  VARIANT (1105): Lys, Ser, Ala, Thr, Gly, or Val
  MOD_RES (1106): Hydroxyproline
  VARIANT (1107): Lys, Ser, Ala, Thr, Gly, or Val
  MOD_RES (1108): Hydroxyproline
  VARIANT (1109): Lys, Ser, Ala, Thr, Gly, or Val
  MOD_RES (1110): Hydroxyproline
  VARIANT (1111): Lys, Ser, Ala, Thr, Gly, or Val
  MOD_RES (1112): Hydroxyproline
  VARIANT (1113): Lys, Ser, Ala, Thr, Gly, or Val
  MOD_RES (1114): Hydroxyproline
  VARIANT (1115): Lys, Ser, Ala, Thr, Gly, or Val
  MOD_RES (1116): Hydroxyproline
  VARIANT (1117): Lys, Ser, Ala, Thr, Gly, or Val
  MOD_RES (1118): Hydroxyproline
  VARIANT (1119): Lys, Ser, Ala, Thr, Gly, or Val
  MOD_RES (1120): Hydroxyproline
  VARIANT (1121): Lys, Ser, Ala, Thr, Gly, or Val
  MOD_RES (1122): Hydroxyproline
  VARIANT (1123): Lys, Ser, Ala, Thr, Gly, or Val
  MOD_RES (1124): Hydroxyproline
  VARIANT (1125): Lys, Ser, Ala, Thr, Gly, or Val
  MOD_RES (1126): Hydroxyproline
  VARIANT (1127): Lys, Ser, Ala, Thr, Gly, or Val
  MOD_RES (1128): Hydroxyproline
  VARIANT (1129): Lys, Ser, Ala, Thr, Gly, or Val
  MOD_RES (1130): Hydroxyproline
  VARIANT (1131): Lys, Ser, Ala, Thr, Gly, or Val
  MOD_RES (1132): Hydroxyproline
  VARIANT (1133): Lys, Ser, Ala, Thr, Gly, or Val
  MOD_RES (1134): Hydroxyproline
  VARIANT (1135): Lys, Ser, Ala, Thr, Gly, or Val
  MOD_RES (1136): Hydroxyproline
  VARIANT (1137): Lys, Ser, Ala, Thr, Gly, or Val
  MOD_RES (1138): Hydroxyproline
  VARIANT (1139): Lys, Ser, Ala, Thr, Gly, or Val
  MOD_RES (1140): Hydroxyproline
  VARIANT (1141): Lys, Ser, Ala, Thr, Gly, or Val
  MOD_RES (1142): Hydroxyproline
  VARIANT (1143): Lys, Ser, Ala, Thr, Gly, or Val
  MOD_RES (1144): Hydroxyproline
  VARIANT (1145): Lys, Ser, Ala, Thr, Gly, or Val
  MOD_RES (1146): Hydroxyproline
  VARIANT (1147): Lys, Ser, Ala, Thr, Gly, or Val
  MOD_RES (1148): Hydroxyproline
  VARIANT (1149): Lys, Ser, Ala, Thr, Gly, or Val
  MOD_RES (1150): Hydroxyproline
  VARIANT (1151): Lys, Ser, Ala, Thr, Gly, or Val
  MOD_RES (1152): Hydroxyproline
  VARIANT (1153): Lys, Ser, Ala, Thr, Gly, or Val
  MOD_RES (1154): Hydroxyproline
  VARIANT (1155): Lys, Ser, Ala, Thr, Gly, or Val
  MOD_RES (1156): Hydroxyproline
  VARIANT (1157): Lys, Ser, Ala, Thr, Gly, or Val
  MOD_RES (1158): Hydroxyproline
  VARIANT (1159): Lys, Ser, Ala, Thr, Gly, or Val
  MOD_RES (1160): Hydroxyproline
  VARIANT (1161): Lys, Ser, Ala, Thr, Gly, or Val
  MOD_RES (1162): Hydroxyproline
  VARIANT (1163): Lys, Ser, Ala, Thr, Gly, or Val
  MOD_RES (1164): Hydroxyproline
  VARIANT (1165): Lys, Ser, Ala, Thr, Gly, or Val
  MOD_RES (1166): Hydroxyproline
  VARIANT (1167): Lys, Ser, Ala, Thr, Gly, or Val
  MOD_RES (1168): Hydroxyproline
  VARIANT (1169): Lys, Ser, Ala, Thr, Gly, or Val
  MOD_RES (1170): Hydroxyproline
  VARIANT (1171): Lys, Ser, Ala, Thr, Gly, or Val
  MOD_RES (1172): Hydroxyproline
  VARIANT (1173): Lys, Ser, Ala, Thr, Gly, or Val
  MOD_RES (1174): Hydroxyproline
  VARIANT (1175): Lys, Ser, Ala, Thr, Gly, or Val
  MOD_RES (1176): Hydroxyproline
  VARIANT (1177): Lys, Ser, Ala, Thr, Gly, or Val
  MOD_RES (1178): Hydroxyproline
  VARIANT (1179): Lys, Ser, Ala, Thr, Gly, or Val
  MOD_RES (1180): Hydroxyproline
  VARIANT (1181): Lys, Ser, Ala, Thr, Gly, or Val
  MOD_RES (1182): Hydroxyproline
  VARIANT (1183): Lys, Ser, Ala, Thr, Gly, or Val
  MOD_RES (1184): Hydroxyproline
  VARIANT (1185): Lys, Ser, Ala, Thr, Gly, or Val
  MOD_RES (1186): Hydroxyproline
  VARIANT (1187): Lys, Ser, Ala, Thr, Gly, or Val
  MOD_RES (1188): Hydroxyproline
  VARIANT (1189): Lys, Ser, Ala, Thr, Gly, or Val
  MOD_RES (1190): Hydroxyproline
  VARIANT (1191): Lys, Ser, Ala, Thr, Gly, or Val
  MOD_RES (1192): Hydroxyproline
  VARIANT (1193): Lys, Ser, Ala, Thr, Gly, or Val
  MOD_RES (1194): Hydroxyproline
  VARIANT (1195): Lys, Ser, Ala, Thr, Gly, or Val
  MOD_RES (1196): Hydroxyproline
  VARIANT (1197): Lys, Ser, Ala, Thr, Gly, or Val
  MOD_RES (1198): Hydroxyproline
  VARIANT (1199): Lys, Ser, Ala, Thr, Gly, or Val
  MOD_RES (1200): Hydroxyproline
  VARIANT (1201): Lys, Ser, Ala, Thr, Gly, or Val
  MOD_RES (1202): Hydroxyproline
  VARIANT (1203): Lys, Ser, Ala, Thr, Gly, or Val
  MOD_RES (1204): Hydroxyproline
  VARIANT (1205): Lys, Ser, Ala, Thr, Gly, or Val
  MOD_RES (1206): Hydroxyproline
  VARIANT (1207): Lys, Ser, Ala, Thr, Gly, or Val
  MOD_RES (1208): Hydroxyproline
  VARIANT (1209): Lys, Ser, Ala, Thr, Gly, or Val
  MOD_RES (1210): Hydroxyproline
  VARIANT (1211): Lys, Ser, Ala, Thr, Gly, or Val
  MOD_RES (1212): Hydroxyproline
  VARIANT (1213): Lys, Ser, Ala, Thr, Gly, or Val
  MOD_RES (1214): Hydroxyproline
  VARIANT (1215): Lys, Ser, Ala, Thr, Gly, or Val
  MOD_RES (1216): Hydroxyproline
  VARIANT (1217): Lys, Ser, Ala, Thr, Gly, or Val
  MOD_RES (1218): Hydroxyproline
  VARIANT (1219): Lys, Ser, Ala, Thr, Gly, or Val
  MOD_RES (1220): Hydroxyproline
  VARIANT (1221): Lys, Ser, Ala, Thr, Gly, or Val
  MOD_RES (1222): Hydroxyproline
  VARIANT (1223): Lys, Ser, Ala, Thr, Gly, or Val
  MOD_RES (1224): Hydroxyproline
  VARIANT (1225): Lys, Ser, Ala, Thr, Gly, or Val
  MOD_RES (1226): Hydroxyproline
  VARIANT (1227): Lys, Ser, Ala, Thr, Gly, or Val
  MOD_RES (1228): Hydroxyproline
  VARIANT (1229): Lys, Ser, Ala, Thr, Gly, or Val
  MOD_RES (1230): Hydroxyproline
  VARIANT (1231): Lys, Ser, Ala, Thr, Gly, or Val
  MOD_RES (1232): Hydroxyproline
  VARIANT (1233): Lys, Ser, Ala, Thr, Gly, or Val
  MOD_RES (1234): Hydroxyproline
  VARIANT (1235): Lys, Ser, Ala, Thr, Gly, or Val
  MOD_RES (1236): Hydroxyproline
  VARIANT (1237): Lys, Ser, Ala, Thr, Gly, or Val
  MOD_RES (1238): Hydroxyproline
  VARIANT (1239): Lys, Ser, Ala, Thr, Gly, or Val
  MOD_RES (1240): Hydroxyproline
  VARIANT (1241): Lys, Ser, Ala, Thr, Gly, or Val
  MOD_RES (1242): Hydroxyproline
  VARIANT (1243): Lys, Ser, Ala, Thr, Gly, or Val
  MOD_RES (1244): Hydroxyproline
  VARIANT (1245): Lys, Ser, Ala, Thr, Gly, or Val
  MOD_RES (1246): Hydroxyproline
  VARIANT (1247): Lys, Ser, Ala, Thr, Gly, or Val
  MOD_RES (1248): Hydroxyproline
  VARIANT (1249): Lys, Ser, Ala, Thr, Gly, or Val
  MOD_RES (1250): Hydroxyproline
  VARIANT (1251): Lys, Ser, Ala, Thr, Gly, or Val
  MOD_RES (1252): Hydroxyproline
  VARIANT (1253): Lys, Ser, Ala, Thr, Gly, or Val
  MOD_RES (1254): Hydroxyproline
  VARIANT (1255): Lys, Ser, Ala, Thr, Gly, or Val
  MOD_RES (1256): Hydroxyproline
  VARIANT (1257): Lys, Ser, Ala, Thr, Gly, or Val
  MOD_RES (1258): Hydroxyproline
  VARIANT (1259): Lys, Ser, Ala, Thr, Gly, or Val
  MOD_RES (1260): Hydroxyproline
  VARIANT (1261): Lys, Ser, Ala, Thr, Gly, or Val
  MOD_RES (1262): Hydroxyproline
  VARIANT (1263): Lys, Ser, Ala, Thr, Gly, or Val
  MOD_RES (1264): Hydroxyproline
  VARIANT (1265): Lys, Ser, Ala, Thr, Gly, or Val
  MOD_RES (1266): Hydroxyproline
  VARIANT (1267): Lys, Ser, Ala, Thr, Gly, or Val
  MOD_RES (1268): Hydroxyproline
  VARIANT (1269): Lys, Ser, Ala, Thr, Gly, or Val
  MOD_RES (1270): Hydroxyproline
  VARIANT (1271): Lys, Ser, Ala, Thr, Gly, or Val
  MOD_RES (1272): Hydroxyproline
  VARIANT (1273): Lys, Ser, Ala, Thr, Gly, or Val
  MOD_RES (1274): Hydroxyproline
  VARIANT (1275): Lys, Ser, Ala, Thr, Gly, or Val
  MOD_RES (1276): Hydroxyproline
  VARIANT (1277): Lys, Ser, Ala, Thr, Gly, or Val
  MOD_RES (1278): Hydroxyproline
  VARIANT (1279): Lys, Ser, Ala, Thr, Gly, or Val
  MOD_RES (1280): Hydroxyproline
  VARIANT (1281): Lys, Ser, Ala, Thr, Gly, or Val
  MOD_RES (1282): Hydroxyproline
  VARIANT (1283): Lys, Ser, Ala, Thr, Gly, or Val
  MOD_RES (1284): Hydroxyproline
  VARIANT (1285): Lys, Ser, Ala, Thr, Gly, or Val
  MOD_RES (1286): Hydroxyproline
  VARIANT (1287): Lys, Ser, Ala, Thr, Gly, or Val
  MOD_RES (1288): Hydroxyproline
  VARIANT (1289): Lys, Ser, Ala, Thr, Gly, or Val
  MOD_RES (1290): Hydroxyproline
  VARIANT (1291): Lys, Ser, Ala, Thr, Gly, or Val
  MOD_RES (1292): Hydroxyproline
  VARIANT (1293): Lys, Ser, Ala, Thr, Gly, or Val
  MOD_RES (1294): Hydroxyproline
  VARIANT (1295): Lys, Ser, Ala, Thr, Gly, or Val
  MOD_RES (1296): Hydroxyproline
  VARIANT (1297): Lys, Ser, Ala, Thr, Gly, or Val
  MOD_RES (1298): Hydroxyproline
  VARIANT (1299): Lys, Ser, Ala, Thr, Gly, or Val
  MOD_RES (1300): Hydroxyproline
  VARIANT (1301): Lys, Ser, Ala, Thr, Gly, or Val
  MOD_RES (1302): Hydroxyproline
  VARIANT (1303): Lys, Ser, Ala, Thr, Gly, or Val
  MOD_RES (1304): Hydroxyproline
  VARIANT (1305): Lys, Ser, Ala, Thr, Gly, or Val
  MOD_RES (1306): Hydroxyproline
  VARIANT (1307): Lys, Ser, Ala, Thr, Gly, or Val
  MOD_RES (1308): Hydroxyproline
  VARIANT (1309): Lys, Ser, Ala, Thr, Gly, or Val
  MOD_RES (1310): Hydroxyproline
  VARIANT (1311): Lys, Ser, Ala, Thr, Gly, or Val
  MOD_RES (1312): Hydroxyproline
  VARIANT (1313): Lys, Ser, Ala, Thr, Gly, or Val
  MOD_RES (1314): Hydroxyproline
  VARIANT (1315): Lys, Ser, Ala, Thr, Gly, or Val
  MOD_RES (1316): Hydroxyproline
  VARIANT (1317): Lys, Ser, Ala, Thr, Gly, or Val
  MOD_RES (1318): Hydroxyproline
  VARIANT (1319): Lys, Ser, Ala, Thr, Gly, or Val
  MOD_RES (1320): Hydroxyproline
  VARIANT (1321): Lys, Ser, Ala, Thr, Gly, or Val
  MOD_RES (1322): Hydroxyproline
  VARIANT (1323): Lys, Ser, Ala, Thr, Gly, or Val
  MOD_RES (1324): Hydroxyproline
  VARIANT (1325): Lys, Ser, Ala, Thr, Gly, or Val
  MOD_RES (1326): Hydroxyproline
  VARIANT (1327): Lys, Ser, Ala, Thr, Gly, or Val
  MOD_RES (1328): Hydroxyproline
  VARIANT (1329): Lys, Ser, Ala, Thr, Gly, or Val
  MOD_RES (1330): Hydroxyproline
  VARIANT (1331): Lys, Ser, Ala, Thr, Gly, or Val
  MOD_RES (1332): Hydroxyproline
  VARIANT (1333): Lys, Ser, Ala, Thr, Gly, or Val
  MOD_RES (1334): Hydroxyproline
  VARIANT (1335): Lys, Ser, Ala, Thr, Gly, or Val
  MOD_RES (1336): Hydroxyproline
  VARIANT (1337): Lys, Ser, Ala, Thr, Gly, or Val
  MOD_RES (1338): Hydroxyproline
  VARIANT (1339): Lys, Ser, Ala, Thr, Gly, or Val
  MOD_RES (1340): Hydroxyproline
  VARIANT (1341): Lys, Ser, Ala, Thr, Gly, or Val
  MOD_RES (1342): Hydroxyproline
  VARIANT (1343): Lys, Ser, Ala, Thr, Gly, or Val
  MOD_RES (1344): Hydroxyproline
  VARIANT (1345): Lys, Ser, Ala, Thr, Gly, or Val
  MOD_RES (1346): Hydroxyproline
  VARIANT (1347): Lys, Ser, Ala, Thr, Gly, or Val
  MOD_RES (1348): Hydroxyproline
  VARIANT (1349): Lys, Ser, Ala, Thr, Gly, or Val
  MOD_RES (1350): Hydroxyproline
  VARIANT (1351): Lys, Ser, Ala, Thr, Gly, or Val
  MOD_RES (1352): Hydroxyproline
  VARIANT (1353): Lys, Ser, Ala, Thr, Gly, or Val
  MOD_RES (1354): Hydroxyproline
  VARIANT (1355): Lys, Ser, Ala, Thr, Gly, or Val
  MOD_RES (1356): Hydroxyproline
  VARIANT (1357): Lys, Ser, Ala, Thr, Gly, or Val
  MOD_RES (1358): Hydroxyproline
  VARIANT (1359): Lys, Ser, Ala, Thr, Gly, or Val
  MOD_RES (1360): Hydroxyproline
  VARIANT (1361): Lys, Ser, Ala, Thr, Gly, or Val
  MOD_RES (1362): Hydroxyproline
  VARIANT (1363): Lys, Ser, Ala, Thr, Gly, or Val
  MOD_RES (1364): Hydroxyproline
  VARIANT (1365): Lys, Ser, Ala, Thr, Gly, or Val
  MOD_RES (1366): Hydroxyproline
  VARIANT (1367): Lys, Ser, Ala, Thr, Gly, or Val
  MOD_RES (1368): Hydroxyproline
  VARIANT (1369): Lys, Ser, Ala, Thr, Gly, or Val
  MOD_RES (1370): Hydroxyproline
  VARIANT (1371): Lys, Ser, Ala, Thr, Gly, or Val
  MOD_RES (1372): Hydroxyproline
  VARIANT (1373): Lys, Ser, Ala, Thr, Gly, or Val
  MOD_RES (1374): Hydroxyproline
  VARIANT (1375): Lys, Ser, Ala, Thr, Gly, or Val
  MOD_RES (1376): Hydroxyproline
  VARIANT (1377): Lys, Ser, Ala, Thr, Gly, or Val
  MOD_RES (1378): Hydroxyproline
  VARIANT (1379): Lys, Ser, Ala, Thr, Gly, or Val
  MOD_RES (1380): Hydroxyproline
  VARIANT (1381): Lys, Ser, Ala, Thr, Gly, or Val
  MOD_RES (1382): Hydroxyproline
  VARIANT (1383): Lys, Ser, Ala, Thr, Gly, or Val
  MOD_RES (1384): Hydroxyproline
  VARIANT (1385): Lys, Ser, Ala, Thr, Gly, or Val
  MOD_RES (1386): Hydroxyproline
  VARIANT (1387): Lys, Ser, Ala, Thr, Gly, or Val
  MOD_RES (1388): Hydroxyproline
  VARIANT (1389): Lys, Ser, Ala, Thr, Gly, or Val
  MOD_RES (1390): Hydroxyproline
  VARIANT (1391): Lys, Ser, Ala, Thr, Gly, or Val
  MOD_RES (1392): Hydroxyproline
  VARIANT (1393): Lys, Ser, Ala, Thr, Gly, or Val
  MOD_RES (1394): Hydroxyproline
  VARIANT (1395): Lys, Ser, Ala, Thr, Gly, or Val
  MOD_RES (1396): Hydroxyproline
  VARIANT (1397): Lys, Ser, Ala, Thr, Gly, or Val
  MOD_RES (1398): Hydroxyproline
  VARIANT (1399): Lys, Ser, Ala, Thr, Gly, or Val
  MOD_RES (1400): Hydroxyproline
  VARIANT (1401): Lys, Ser, Ala, Thr, Gly, or Val
  MOD_RES (1402): Hydroxyproline
  VARIANT (1403): Lys, Ser, Ala, Thr, Gly, or Val
  MOD_RES (1404): Hydroxyproline
  VARIANT (1405): Lys, Ser, Ala, Thr, Gly, or Val
  MOD_RES (1406): Hydroxyproline
  VARIANT (1407): Lys, Ser, Ala, Thr, Gly, or Val
  MOD_RES (1408): Hydroxyproline
  VARIANT (1409): Lys, Ser, Ala, Thr, Gly, or Val
  MOD_RES (1410): Hydroxyproline
  VARIANT (1411): Lys, Ser, Ala, Thr, Gly, or Val
  MOD_RES (1412): Hydroxyproline
  VARIANT (1413): Lys, Ser, Ala, Thr, Gly, or Val
  MOD_RES (1414): Hydroxyproline
  VARIANT (1415): Lys, Ser, Ala, Thr, Gly, or Val
  MOD_RES (1416): Hydroxyproline
  VARIANT (1417): Lys, Ser, Ala, Thr, Gly, or Val
  MOD_RES (1418): Hydroxyproline
  VARIANT (1419): Lys, Ser, Ala, Thr, Gly, or Val
  MOD_RES (1420): Hydroxyproline
  VARIANT (1421): Lys, Ser, Ala, Thr, Gly, or Val
  MOD_RES (1422): Hydroxyproline
  VARIANT (1423): Lys, Ser, Ala, Thr, Gly, or Val
  MOD_RES (1424): Hydroxyproline
  VARIANT (1425): Lys, Ser, Ala, Thr, Gly, or Val
  MOD_RES (1426): Hydroxyproline
  VARIANT (1427): Lys, Ser, Ala, Thr, Gly, or Val
  MOD_RES (1428): Hydroxyproline
  VARIANT (1429): Lys, Ser, Ala, Thr, Gly, or Val
  MOD_RES (1430): Hydroxyproline
  VARIANT (1431): Lys, Ser, Ala, Thr, Gly, or Val
  MOD_RES (1432): Hydroxyproline
  VARIANT (1433): Lys, Ser, Ala, Thr, Gly, or Val
  MOD_RES (1434): Hydroxyproline
  VARIANT (1435): Lys, Ser, Ala, Thr, Gly, or Val
  MOD_RES (1436): Hydroxyproline
  VARIANT (1437): Lys, Ser, Ala, Thr, Gly, or Val
  MOD_RES (1438): Hydroxyproline
  VARIANT (1439): Lys, Ser, Ala, Thr, Gly, or Val
  MOD_RES (1440): Hydroxyproline
  VARIANT (1441): Lys, Ser, Ala, Thr, Gly, or Val
  MOD_RES (1442): Hydroxyproline
  VARIANT (1443): Lys, Ser, Ala, Thr, Gly, or Val
  MOD_RES (1444): Hydroxyproline
  VARIANT (1445): Lys, Ser, Ala, Thr, Gly, or Val
  MOD_RES (1446): Hydroxyproline
  VARIANT (1447): Lys, Ser, Ala, Thr, Gly, or Val
  MOD_RES (1448): Hydroxyproline
  VARIANT (1449): Lys, Ser, Ala, Thr, Gly, or Val
  MOD_RES (1450): Hydroxyproline
  VARIANT (1451): Lys, Ser, Ala, Thr, Gly, or Val
  MOD_RES (1452): Hydroxyproline
  VARIANT (1453): Lys, Ser, Ala, Thr, Gly, or Val
  MOD_RES (1454): Hydroxyproline
  VARIANT (1455): Lys, Ser, Ala, Thr, Gly, or Val
  MOD_RES (1456): Hydroxyproline
  VARIANT (1457): Lys, Ser, Ala, Thr, Gly, or Val
  MOD_RES (1458): Hydroxyproline
  VARIANT (1459): Lys, Ser, Ala, Thr, Gly, or Val
  MOD_RES (1460): Hydroxyproline
  VARIANT (1461): Lys, Ser, Ala, Thr, Gly, or Val
  MOD_RES (1462): Hydroxyproline
  VARIANT (1463): Lys, Ser, Ala, Thr, Gly, or Val
  MOD_RES (1464): Hydroxyproline
  VARIANT (1465): Lys, Ser, Ala, Thr, Gly, or Val
  MOD_RES (1466): Hydroxyproline
  VARIANT (1467): Lys, Ser, Ala, Thr, Gly, or Val
  MOD_RES (1468): Hydroxyproline
  VARIANT (1469): Lys, Ser, Ala, Thr, Gly, or Val
  MOD_RES (1470): Hydroxyproline
  VARIANT (1471): Lys, Ser, Ala, Thr, Gly, or Val
  MOD_RES (1472): Hydroxyproline
  VARIANT (1473): Lys, Ser, Ala, Thr, Gly, or Val
  MOD_RES (1474): Hydroxyproline
  VARIANT (1475): Lys, Ser, Ala, Thr, Gly, or Val
  MOD_RES (1476): Hydroxyproline
  VARIANT (1477): Lys, Ser, Ala, Thr, Gly, or Val
  MOD_RES (1478): Hydroxyproline
  VARIANT (1479): Lys, Ser, Ala, Thr, Gly, or Val
  MOD_RES (1480): Hydroxyproline
  VARIANT (1481): Lys, Ser, Ala, Thr, Gly, or Val
  MOD_RES (1482): Hydroxyproline
  VARIANT (1483): Lys, Ser, Ala, Thr, Gly, or Val
  MOD_RES (1484): Hydroxyproline
  VARIANT (1485): Lys, Ser, Ala, Thr, Gly, or Val
  MOD_RES (1486): Hydroxyproline
  VARIANT (1487): Lys, Ser, Ala, Thr, Gly, or Val
  MOD_RES (1488): Hydroxyproline
  VARIANT (1489): Lys, Ser, Ala, Thr, Gly, or Val
  MOD_RES (1490): Hydroxyproline
  VARIANT (1491): Lys, Ser, Ala, Thr, Gly, or Val
  MOD_RES (1492): Hydroxyproline
  VARIANT (1493): Lys, Ser, Ala, Thr, Gly, or Val
  MOD_RES (1494): Hydroxyproline
  VARIANT (1495): Lys, Ser, Ala, Thr, Gly, or Val
  MOD_RES (1496): Hydroxyproline
  VARIANT (1497): Lys, Ser, Ala, Thr, Gly, or Val
  MOD_RES (1498): Hydroxyproline
  VARIANT (1499): Lys, Ser, Ala, Thr, Gly, or Val
  MOD_RES (1500): Hydroxyproline
  VARIANT (1501): Lys, Ser, Ala, Thr, Gly, or Val
  MOD_RES (1502): Hydroxyproline
  VARIANT (1503): Lys, Ser, Ala, Thr, Gly, or Val
  MOD_RES (1504): Hydroxyproline
  VARIANT (1505): Lys, Ser, Ala, Thr, Gly, or Val
  MOD_RES (1506): Hydroxyproline
  VARIANT (1507): Lys, Ser, Ala, Thr, Gly, or Val
  MOD_RES (1508): Hydroxyproline
  VARIANT (1509): Lys, Ser, Ala, Thr, Gly, or Val
  MOD_RES (1510): Hydroxyproline
  VARIANT (1511): Lys, Ser, Ala, Thr, Gly, or Val
  MOD_RES (1512): Hydroxyproline
  VARIANT (1513): Lys, Ser, Ala, Thr, Gly, or Val
  MOD_RES (1514): Hydroxyproline
  VARIANT (1515): Lys, Ser, Ala, Thr, Gly, or Val
  MOD_RES (1516): Hydroxyproline
  VARIANT (1517): Lys, Ser, Ala, Thr, Gly, or Val
  MOD_RES (1518): Hydroxyproline
  VARIANT (1519): Lys, Ser, Ala, Thr, Gly, or Val
  MOD_RES (1520): Hydroxyproline
  VARIANT (1521): Lys, Ser, Ala, Thr, Gly, or Val
  MOD_RES (1522): Hydroxyproline
  VARIANT (1523): Lys, Ser, Ala, Thr, Gly, or Val
  MOD_RES (1524): Hydroxyproline
  VARIANT (1525): Lys, Ser, Ala, Thr, Gly, or Val
  MOD_RES (1526): Hydroxyproline
  VARIANT (1527): Lys, Ser, Ala, Thr, Gly, or Val
  MOD_RES (1528): Hydroxyproline
  VARIANT (1529): Lys, Ser, Ala, Thr, Gly, or Val
  MOD_RES (1530): Hydroxyproline
  VARIANT (1531): Lys, Ser, Ala, Thr, Gly, or Val
  MOD_RES (1532): Hydroxyproline
  VARIANT (1533): Lys, Ser, Ala, Thr, Gly, or Val
  MOD_RES (1534): Hydroxyproline
  VARIANT (1535): Lys, Ser, Ala, Thr, Gly, or Val
  MOD_RES (1536): Hydroxyproline
  VARIANT (1537): Lys, Ser, Ala, Thr, Gly, or Val
  MOD_RES (1538): Hydroxyproline
  VARIANT (1539): Lys, Ser, Ala, Thr, Gly, or Val
  MOD_RES (1540): Hydroxyproline
  VARIANT (1541): Lys, Ser, Ala, Thr, Gly, or Val
  MOD_RES (1542): Hydroxyproline
  VARIANT (1543): Lys, Ser, Ala, Thr, Gly, or Val
  MOD_RES (1544): Hydroxyproline
  VARIANT (1545): Lys, Ser, Ala, Thr, Gly, or Val
  MOD_RES (1546): Hydroxyproline
  VARIANT (1547): Lys, Ser, Ala, Thr, Gly, or Val
  MOD_RES (1548): Hydroxyproline
  VARIANT (1549): Lys, Ser, Ala, Thr, Gly, or Val
  MOD_RES (1550): Hydroxyproline
  VARIANT (1551): Lys, Ser, Ala, Thr, Gly, or Val
  MOD_RES (1552): Hydroxyproline
  VARIANT (1553): Lys, Ser, Ala, Thr, Gly, or Val
  MOD_RES (1554): Hydroxyproline
  VARIANT (1555): Lys, Ser, Ala, Thr, Gly, or Val
  MOD_RES (1556): Hydroxyproline
  VARIANT (1557): Lys, Ser, Ala, Thr, Gly, or Val
  MOD_RES (1558): Hydroxyproline
  VARIANT (1559): Lys, Ser, Ala, Thr, Gly, or Val
  MOD_RES (1560): Hydroxyproline
  VARIANT (1561): Lys, Ser, Ala, Thr, Gly, or Val
  MOD_RES (1562): Hydroxyproline
  VARIANT (1563): Lys, Ser, Ala, Thr, Gly, or Val
  MOD_RES (1564): Hydroxyproline
  VARIANT (1565): Lys, Ser, Ala, Thr, Gly, or Val
  MOD_RES (1566): Hydroxyproline
  VARIANT (1567): Lys, Ser, Ala, Thr, Gly, or Val
  MOD_RES (1568): Hydroxyproline
  VARIANT (1569): Lys, Ser, Ala, Thr, Gly, or Val
  MOD_RES (1570): Hydroxyproline
  VARIANT (1571): Lys, Ser, Ala, Thr, Gly, or Val
  MOD_RES (1572): Hydroxyproline
  VARIANT (1573): Lys, Ser, Ala, Thr, Gly, or Val
  MOD_RES (1574): Hydroxyproline
  VARIANT (1575): Lys, Ser, Ala, Thr, Gly, or Val
  MOD_RES (1576): Hydroxyproline
  VARIANT (1577): Lys, Ser, Ala, Thr, Gly, or Val
  MOD_RES (1578): Hydroxyproline
  VARIANT (1579): Lys, Ser, Ala, Thr, Gly, or Val
  MOD_RES (1580): Hydroxyproline
  VARIANT (1581): Lys, Ser, Ala, Thr, Gly, or Val
  MOD_RES (1582): Hydroxyproline
  VARIANT (1583): Lys, Ser, Ala, Thr, Gly, or Val
  MOD_RES (1584): Hydroxyproline
  VARIANT (1585): Lys, Ser, Ala, Thr, Gly, or Val
  MOD_RES (1586): Hydroxyproline
  VARIANT (1587): Lys, Ser, Ala, Thr, Gly, or Val
  MOD_RES (1588): Hydroxyproline
  VARIANT (1589): Lys, Ser, Ala, Thr, Gly, or Val
  MOD_RES (1590): Hydroxyproline
  VARIANT (1591): Lys, Ser, Ala, Thr, Gly, or Val
  MOD_RES (1592): Hydroxyproline
  VARIANT (1593): Lys, Ser, Ala, Thr, Gly, or Val
  MOD_RES (1594): Hydroxyproline
  VARIANT (1595): Lys, Ser, Ala, Thr, Gly, or Val
  MOD_RES (1596): Hydroxyproline
  VARIANT (1597): Lys, Ser, Ala, Thr, Gly, or Val
  MOD_RES (1598): Hydroxyproline
  VARIANT (1599): Lys, Ser, Ala, Thr, Gly, or Val
  MOD_RES (1600): Hydroxyproline
  VARIANT (1601): Lys, Ser, Ala, Thr, Gly, or Val
  MOD_RES (1602): Hydroxyproline
  VARIANT (1603): Lys, Ser, Ala, Thr, Gly, or Val
  MOD_RES (1604): Hydroxyproline
  VARIANT (1605): Lys, Ser, Ala, Thr, Gly, or Val
  MOD_RES (1606): Hydroxyproline
  VARIANT (1607): Lys, Ser, Ala, Thr, Gly, or Val
  MOD_RES (1608): Hydroxyproline
  VARIANT (1609): Lys, Ser, Ala, Thr, Gly, or Val
  MOD_RES (1610): Hydroxyproline
  VARIANT (1611): Lys, Ser, Ala, Thr, Gly, or Val
  MOD_RES (1612): Hydroxyproline
  VARIANT (1613): Lys, Ser, Ala, Thr, Gly, or Val
  MOD_RES (1614): Hydroxyproline
  VARIANT (1615): Lys, Ser, Ala, Thr, Gly, or Val
  MOD_RES (1616): Hydroxyproline
  VARIANT (1617): Lys, Ser, Ala, Thr, Gly, or Val
  MOD_RES (1618): Hydroxyproline
  VARIANT (1619): Lys, Ser, Ala, Thr, Gly, or Val
  MOD_RES (1620): Hydroxyproline
  VARIANT (1621): Lys, Ser, Ala, Thr, Gly, or Val
  MOD_RES (1622): Hydroxyproline
  VARIANT (1623): Lys, Ser, Ala, Thr, Gly, or Val
  MOD_RES (1624): Hydroxyproline
  VARIANT (1625): Lys, Ser, Ala, Thr, Gly, or Val
  MOD_RES (1626): Hydroxyproline
  VARIANT (1627): Lys, Ser, Ala, Thr, Gly, or Val
  MOD_RES (1628): Hydroxyproline
  VARIANT (1629): Lys, Ser, Ala, Thr, Gly, or Val
  MOD_RES (1630): Hydroxyproline
  VARIANT (1631): Lys, Ser, Ala, Thr, Gly, or Val
  MOD_RES (1632): Hydroxyproline
  VARIANT (1633): Lys, Ser, Ala, Thr, Gly, or Val
  MOD_RES (1634): Hydroxyproline
  VARIANT (1635): Lys, Ser, Ala, Thr, Gly, or Val
  MOD_RES (1636): Hydroxyproline
  VARIANT (1637): Lys, Ser, Ala, Thr, Gly, or Val
  MOD_RES (1638): Hydroxyproline
  VARIANT (1639): Lys, Ser, Ala, Thr, Gly, or Val
  MOD_RES (1640): Hydroxyproline
  VARIANT (1641): Lys, Ser, Ala, Thr, Gly, or Val
  MOD_RES (1642): Hydroxyproline
  VARIANT (1643): Lys, Ser, Ala, Thr, Gly, or Val
  MOD_RES (1644): Hydroxyproline
  VARIANT (1645): Lys, Ser, Ala, Thr, Gly, or Val
  MOD_RES (1646): Hydroxyproline
  VARIANT (1647): Lys, Ser, Ala, Thr, Gly, or Val
  MOD_RES (1648): Hydroxyproline
  VARIANT (1649): Lys, Ser, Ala, Thr, Gly, or Val
  MOD_RES (1650): Hydroxyproline
  VARIANT (1651): Lys, Ser, Ala, Thr, Gly, or Val
  MOD_RES (1652): Hydroxyproline
  VARIANT (1653): Lys, Ser, Ala, Thr, Gly, or Val
  MOD_RES (1654): Hydroxyproline
  VARIANT (1655): Lys, Ser, Ala, Thr, Gly, or Val
  MOD_RES (1656): Hydroxyproline
  VARIANT (1657): Lys, Ser, Ala, Thr, Gly, or Val
  MOD_RES (1658): Hydroxyproline
  VARIANT (1659): Lys, Ser, Ala, Thr, Gly, or Val
  MOD_RES (1660): Hydroxyproline
  VARIANT (1661): Lys, Ser, Ala, Thr, Gly, or Val
  MOD_RES (1662): Hydroxyproline
  VARIANT (1663): Lys, Ser, Ala, Thr, Gly, or Val
  MOD_RES (1664): Hydroxyproline
  VARIANT (1665): Lys, Ser, Ala, Thr, Gly, or Val
  MOD_RES (1666): Hydroxyproline
  VARIANT (1667): Lys, Ser, Ala, Thr, Gly, or Val
  MOD_RES (1668): Hydroxyproline
  VARIANT (1669): Lys, Ser, Ala, Thr, Gly, or Val
  MOD_RES (1670): Hydroxyproline
  VARIANT (1671): Lys, Ser, Ala, Thr, Gly, or Val
  MOD_RES (1672): Hydroxyproline
  VARIANT (1673): Lys, Ser, Ala, Thr, Gly, or Val
  MOD_RES (1674): Hydroxyproline
  VARIANT (1675): Lys, Ser, Ala, Thr, Gly, or Val
  MOD_RES (1676): Hydroxyproline
  VARIANT (1677): Lys, Ser, Ala, Thr, Gly, or Val
  MOD_RES (1678): Hydroxyproline
  VARIANT (1679): Lys, Ser, Ala, Thr, Gly, or Val
  MOD_RES (1680): Hydroxyproline
  VARIANT (1681): Lys, Ser, Ala, Thr, Gly, or Val
  MOD_RES (1682): Hydroxyproline
  VARIANT (1683): Lys, Ser, Ala, Thr, Gly, or Val
  MOD_RES (1684): Hydroxyproline
  VARIANT (1685): Lys, Ser, Ala, Thr, Gly, or Val
  MOD_RES (1686): Hydroxyproline
  VARIANT (1687): Lys, Ser, Ala, Thr, Gly, or Val
  MOD_RES (1688): Hydroxyproline
  VARIANT (1689): Lys, Ser, Ala, Thr, Gly, or Val
  MOD_RES (1690): Hydroxyproline
  VARIANT (1691): Lys, Ser, Ala, Thr, Gly, or Val
  MOD_RES (1692): Hydroxyproline
  VARIANT (1693): Lys, Ser, Ala, Thr, Gly, or Val
  MOD_RES (1694): Hydroxyproline
  VARIANT (1695): Lys, Ser, Ala, Thr, Gly, or Val
  MOD_RES (1696): Hydroxyproline
  VARIANT (1697): Lys, Ser, Ala, Thr, Gly, or Val
  MOD_RES (1698): Hydroxyproline
  VARIANT (1699): Lys, Ser, Ala, Thr, Gly, or Val
  MOD_RES (1700): Hydroxyproline
  VARIANT (1701): Lys, Ser, Ala, Thr, Gly, or Val
  MOD_RES (1702): Hydroxyproline
  VARIANT (1703): Lys, Ser, Ala, Thr, Gly, or Val
  MOD_RES (1704): Hydroxyproline
  VARIANT (1705): Lys, Ser, Ala, Thr, Gly, or Val
  MOD_RES (1706): Hydroxyproline
  VARIANT (1707): Lys, Ser, Ala, Thr, Gly, or Val
  MOD_RES (1708): Hydroxyproline
  VARIANT (1709): Lys, Ser, Ala, Thr, Gly, or Val
  MOD_RES (1710): Hydroxyproline
  VARIANT (1711): Lys, Ser, Ala, Thr, Gly, or Val
  MOD_RES (1712): Hydroxyproline
  VARIANT (1713): Lys, Ser, Ala, Thr, Gly, or Val
  MOD_RES (1714): Hydroxyproline
  VARIANT (1715): Lys, Ser, Ala, Thr, Gly, or Val
  MOD_RES (1716): Hydroxyproline
  VARIANT (1717): Lys, Ser, Ala, Thr, Gly, or Val
  MOD_RES (1718): Hydroxyproline
  VARIANT (1719): Lys, Ser, Ala, Thr, Gly, or Val
  MOD_RES (1720): Hydroxyproline
  VARIANT (1721): Lys, Ser, Ala, Thr, Gly, or Val
  MOD_RES (1722): Hydroxyproline
  VARIANT (1723): Lys, Ser, Ala, Thr, Gly, or Val
  MOD_RES (1724): Hydroxyproline
  VARIANT (1725): Lys, Ser, Ala, Thr, Gly, or Val
  MOD_RES (1726): Hydroxyproline
  VARIANT (1727): Lys, Ser, Ala, Thr, Gly, or Val
  MOD_RES (1728): Hydroxyproline
  VARIANT (1729): Lys, Ser, Ala, Thr, Gly, or Val
  MOD_RES (1730): Hydroxyproline
  VARIANT (1731): Lys, Ser, Ala, Thr, Gly, or Val
  MOD_RES (1732): Hydroxyproline
  VARIANT (1733): Lys, Ser, Ala, Thr, Gly, or Val
  MOD_RES (1734): Hydroxyproline
  VARIANT (1735): Lys, Ser, Ala, Thr, Gly, or Val
  MOD_RES (1736): Hydroxyproline
  VARIANT (1737): Lys, Ser, Ala, Thr, Gly, or Val
  MOD_RES (1738): Hydroxyproline
  VARIANT (1739): Lys, Ser, Ala, Thr, Gly, or Val
  MOD_RES (1740): Hydroxyproline
  VARIANT (1741): Lys, Ser, Ala, Thr, Gly, or Val
  MOD_RES (1742): Hydroxyproline
  VARIANT (1743): Lys, Ser, Ala, Thr, Gly, or Val
  MOD_RES (1744): Hydroxyproline
  VARIANT (1745): Lys, Ser, Ala, Thr, Gly, or Val
  MOD_RES (1746): Hydroxyproline
  VARIANT (1747): Lys, Ser, Ala, Thr, Gly, or Val
  MOD_RES (1748): Hydroxyproline
  VARIANT (1749): Lys, Ser, Ala, Thr, Gly, or Val
  MOD_RES (1750): Hydroxyproline
  VARIANT (1751): Lys, Ser, Ala, Thr, Gly, or Val
  MOD_RES (1752): Hydroxyproline
  VARIANT (1753): Lys, Ser, Ala, Thr, Gly, or Val
  MOD_RES (1754): Hydroxyproline
  VARIANT (1755): Lys, Ser, Ala, Thr, Gly, or Val
  MOD_RES (1756): Hydroxyproline
  VARIANT (1757): Lys, Ser, Ala, Thr, Gly, or Val
  MOD_RES (1758): Hydroxyproline
  VARIANT (1759): Lys, Ser, Ala, Thr, Gly, or Val
  MOD_RES (1760): Hydroxyproline
  VARIANT (1761): Lys, Ser, Ala, Thr, Gly, or Val
  MOD_RES (1762): Hydroxyproline
  VARIANT (1763): Lys, Ser, Ala, Thr, Gly, or Val
  MOD_RES (1764): Hydroxyproline
  VARIANT (1765): Lys, Ser, Ala, Thr, Gly, or Val
  MOD_RES (1766): Hydroxyproline
  VARIANT (1767): Lys, Ser, Ala, Thr, Gly, or Val
  MOD_RES (1768): Hydroxyproline
  VARIANT (1769): Lys, Ser, Ala, Thr, Gly, or Val
  MOD_RES (1770): Hydroxyproline
  VARIANT (1771): Lys, Ser, Ala, Thr, Gly, or Val
  MOD_RES (1772): Hydroxyproline
  VARIANT (1773): Lys, Ser, Ala, Thr, Gly, or Val
  MOD_RES (1774): Hydroxyproline
  VARIANT (1775): Lys, Ser, Ala, Thr, Gly, or Val
  MOD_RES (1776): Hydroxyproline
  VARIANT (1777): Lys, Ser, Ala, Thr, Gly, or Val
  MOD_RES (1778): Hydroxyproline
  VARIANT (1779): Lys, Ser, Ala, Thr, Gly, or Val
  MOD_RES (1780): Hydroxyproline
  VARIANT (1781): Lys, Ser, Ala, Thr, Gly, or Val
  MOD_RES (1782): Hydroxyproline
  VARIANT (1783): Lys, Ser, Ala, Thr, Gly, or Val
  MOD_RES (1784): Hydroxyproline
  VARIANT (1785): Lys, Ser, Ala, Thr, Gly, or Val
  MOD_RES (1786): Hydroxyproline
  VARIANT (1787): Lys, Ser, Ala, Thr, Gly, or Val
  MOD_RES (1788): Hydroxyproline
  VARIANT (1789): Lys, Ser, Ala, Thr, Gly, or Val
  MOD_RES (1790): Hydroxyproline
  VARIANT (1791): Lys, Ser, Ala, Thr, Gly, or Val
  MOD_RES (1792): Hydroxyproline
  VARIANT (1793): Lys, Ser, Ala, Thr, Gly, or Val
  MOD_RES (1794): Hydroxyproline
  VARIANT (1795): Lys, Ser, Ala, Thr, Gly, or Val
  MOD_RES (1796): Hydroxyproline
  VARIANT (1797): Lys, Ser, Ala, Thr, Gly, or Val
  MOD_RES (1798): Hydroxyproline
  VARIANT (1799): Lys, Ser, Ala, Thr, Gly, or Val
  MOD_RES (1800): Hydroxyproline
  VARIANT (1801): Lys, Ser, Ala, Thr, Gly, or Val
  MOD_RES (1802): Hydroxyproline
  VARIANT (1803): Lys, Ser, Ala, Thr, Gly, or Val
  MOD_RES (1804): Hydroxyproline
  VARIANT (1805): Lys, Ser, Ala, Thr, Gly, or Val
  MOD_RES (1806): Hydroxyproline
  VARIANT (1807): Lys, Ser, Ala, Thr, Gly, or Val
  MOD_RES (1808): Hydroxyproline
  VARIANT (1809): Lys, Ser, Ala, Thr, Gly, or Val
  MOD_RES (1810): Hydroxyproline
  VARIANT (1811): Lys, Ser, Ala, Thr, Gly, or Val
  MOD_RES (1812): Hydroxyproline
  VARIANT (1813): Lys, Ser, Ala, Thr, Gly, or Val
  MOD_RES (1814): Hydroxyproline
  VARIANT (1815): Lys, Ser, Ala, Thr, Gly, or Val
  MOD_RES (1816): Hydroxyproline
  VARIANT (1817): Lys, Ser, Ala, Thr, Gly, or Val
  MOD_RES (1818): Hydroxyproline
  VARIANT (1819): Lys, Ser, Ala, Thr, Gly, or Val
  MOD_RES (1820): Hydroxyproline
  VARIANT (1821): Lys, Ser, Ala, Thr, Gly, or Val
  MOD_RES (1822): Hydroxyproline
  VARIANT (1823): Lys, Ser, Ala, Thr, Gly, or Val
  MOD_RES (1824): Hydroxyproline
  VARIANT (1825): Lys, Ser, Ala, Thr, Gly, or Val
  MOD_RES (1826): Hydroxyproline
  VARIANT (1827): Lys, Ser, Ala, Thr, Gly, or Val
  MOD_RES (1828): Hydroxyproline
  VARIANT (1829): Lys, Ser, Ala, Thr, Gly, or Val
  MOD_RES (1830): Hydroxyproline
  VARIANT (1831): Lys, Ser, Ala, Thr, Gly, or Val
  MOD_RES (1832): Hydroxyproline
  VARIANT (1833): Lys, Ser, Ala, Thr, Gly, or Val
  MOD_RES (1834): Hydroxyproline
  VARIANT (1835): Lys, Ser, Ala, Thr, Gly, or Val
  MOD_RES (1836): Hydroxyproline
  VARIANT (1837): Lys, Ser, Ala, Thr, Gly, or Val
  MOD_RES (1838): Hydroxyproline
  VARIANT (1839): Lys, Ser, Ala, Thr, Gly, or Val
  MOD_RES (1840): Hydroxyproline
  VARIANT (1841): Lys, Ser, Ala, Thr, Gly, or Val
  MOD_RES (1842): Hydroxyproline
  VARIANT (1843): Lys, Ser, Ala, Thr, Gly, or Val
  MOD_RES (1844): Hydroxyproline
  VARIANT (1845): Lys, Ser, Ala, Thr, Gly, or Val
  MOD_RES (1846): Hydroxyproline
  VARIANT (1847): Lys, Ser, Ala, Thr, Gly, or Val
  MOD_RES (1848): Hydroxyproline
  VARIANT (1849): Lys, Ser, Ala, Thr, Gly, or Val
  MOD_RES (1850): Hydroxyproline
  VARIANT (1851): Lys, Ser, Ala, Thr, Gly, or Val
  MOD_RES (1852): Hydroxyproline
  VARIANT (1853): Lys, Ser, Ala, Thr, Gly, or Val
  MOD_RES (1854): Hydroxyproline
  VARIANT (1855): Lys, Ser, Ala, Thr, Gly, or Val
  MOD_RES (1856): Hydroxyproline
  VARIANT (1857): Lys, Ser, Ala, Thr, Gly, or Val
  MOD_RES (1858): Hydroxyproline
  VARIANT (1859): Lys, Ser, Ala, Thr, Gly, or Val
  MOD_RES (1860): Hydroxyproline
  VARIANT (1861): Lys, Ser, Ala, Thr, Gly, or Val
  MOD_RES (1862): Hydroxyproline
  VARIANT (1863): Lys, Ser, Ala, Thr, Gly, or Val
  MOD_RES (1864): Hydroxyproline
  VARIANT (1865): Lys, Ser, Ala, Thr, Gly, or Val
  MOD_RES (1866): Hydroxyproline
  VARIANT (1867): Lys, Ser, Ala, Thr, Gly, or Val
  MOD_RES (1868): Hydroxyproline
  VARIANT (1869): Lys, Ser, Ala, Thr, Gly, or Val
  MOD_RES (1870): Hydroxyproline
  VARIANT (1871): Lys, Ser, Ala, Thr, Gly, or Val
  MOD_RES (1872): Hydroxyproline
  VARIANT (1873): Lys, Ser, Ala, Thr, Gly, or Val
  MOD_RES (1874): Hydroxyproline
  VARIANT (1875): Lys, Ser, Ala, Thr, Gly, or Val
  MOD_RES (1876): Hydroxyproline
  VARIANT (1877): Lys, Ser, Ala, Thr, Gly, or Val
  MOD_RES (1878): Hydroxyproline
  VARIANT (1879): Lys, Ser, Ala, Thr, Gly, or Val
  MOD_RES (1880): Hydroxyproline
  VARIANT (1881): Lys, Ser, Ala, Thr, Gly, or Val
  MOD_RES (1882): Hydroxyproline
  VARIANT (1883): Lys, Ser, Ala, Thr, Gly, or Val
  MOD_RES (1884): Hydroxyproline
  VARIANT (1885): Lys, Ser, Ala, Thr, Gly, or Val
  MOD_RES (1886): Hydroxyproline
  VARIANT (1887): Lys, Ser, Ala, Thr, Gly, or Val
  MOD_RES (1888): Hydroxyproline
  VARIANT (1889): Lys, Ser, Ala, Thr, Gly, or Val
  MOD_RES (1890): Hydroxyproline
  VARIANT (1891): Lys, Ser, Ala, Thr, Gly, or Val
  MOD_RES (1892): Hydroxyproline
  VARIANT (1893): Lys, Ser, Ala, Thr, Gly, or Val
  MOD_RES (1894): Hydroxyproline
  VARIANT (1895): Lys, Ser, Ala, Thr, Gly, or Val
  MOD_RES (1896): Hydroxyproline
  VARIANT (1897): Lys, Ser, Ala, Thr, Gly, or Val
  MOD_RES (1898): Hydroxyproline
  VARIANT (1899): Lys, Ser, Ala, Thr, Gly, or Val
  MOD_RES (1900): Hydroxyproline
  VARIANT (1901): Lys, Ser, Ala, Thr, Gly, or Val
  MOD_RES (1902): Hydroxyproline
  VARIANT (1903): Lys, Ser, Ala, Thr, Gly, or Val
  MOD_RES (1904): Hydroxyproline
  VARIANT (1905): Lys, Ser, Ala, Thr, Gly, or Val
  MOD_RES (1906): Hydroxyproline
  VARIANT (1907): Lys, Ser, Ala, Thr, Gly, or Val
  MOD_RES (1908): Hydroxyproline
  VARIANT (1909): Lys, Ser, Ala, Thr, Gly, or Val
  MOD_RES (1910): Hydroxyproline
  VARIANT (1911): Lys, Ser, Ala, Thr, Gly, or Val
  MOD_RES (1912): Hydroxyproline
  VARIANT (1913): Lys, Ser, Ala, Thr, Gly, or Val
  MOD_RES (1914): Hydroxyproline
  VARIANT (1915): Lys, Ser, Ala, Thr, Gly, or Val
  MOD_RES (1916): Hydroxyproline
  VARIANT (1917): Lys, Ser, Ala, Thr, Gly, or Val
  MOD_RES (1918): Hydroxyproline
  VARIANT (1919): Lys, Ser, Ala, Thr, Gly, or Val
  MOD_RES (1920): Hydroxyproline
  VARIANT (1921): Lys, Ser, Ala, Thr, Gly, or Val
  MOD_RES (1922): Hydroxyproline
  VARIANT (1923): Lys, Ser, Ala, Thr, Gly, or Val
  MOD_RES (1924): Hydroxyproline
  VARIANT (1925): Lys, Ser, Ala, Thr, Gly, or Val
  MOD_RES (1926): Hydroxyproline
  VARIANT (1927): Lys, Ser, Ala, Thr, Gly, or Val
  MOD_RES (1928): Hydroxyproline
  VARIANT (1929): Lys, Ser, Ala, Thr, Gly, or Val
  MOD_RES (1930): Hydroxyproline
  VARIANT (1931): Lys, Ser, Ala, Thr, Gly, or Val
  MOD_RES (1932): Hydroxyproline
  VARIANT (1933): Lys, Ser, Ala, Thr, Gly, or Val
  MOD_RES (1934): Hydroxyproline
  VARIANT (1935): Lys, Ser, Ala, Thr, Gly, or Val
  MOD_RES (1936): Hydroxyproline
  VARIANT (1937): Lys, Ser, Ala, Thr, Gly, or Val
  MOD_RES (1938): Hydroxyproline
  VARIANT (1939): Lys, Ser, Ala, Thr, Gly, or Val
  MOD_RES (1940): Hydroxyproline
  VARIANT (1941): Lys, Ser, Ala, Thr, Gly, or Val
  MOD_RES (1942): Hydroxyproline
  VARIANT (1943): Lys, Ser, Ala, Thr, Gly, or Val
  MOD_RES (1944): Hydroxyproline
  VARIANT (1945): Lys, Ser, Ala, Thr, Gly, or Val
  MOD_RES (1946): Hydroxyproline
  VARIANT (1947): Lys, Ser, Ala, Thr, Gly, or Val
  MOD_RES (1948): Hydroxyproline
  VARIANT (1949): Lys, Ser, Ala, Thr, Gly, or Val
  MOD_RES (1950): Hydroxyproline
  VARIANT (1951): Lys, Ser, Ala, Thr, Gly, or Val
  MOD_RES (1952): Hydroxyproline
  VARIANT (1953): Lys, Ser, Ala, Thr, Gly, or Val
  MOD_RES (1954): Hydroxyproline
  VARIANT (1955): Lys, Ser, Ala, Thr, Gly, or Val
  MOD_RES (1956): Hydroxyproline
  VARIANT (1957): Lys, Ser, Ala, Thr, Gly, or Val
  MOD_RES (1958): Hydroxyproline
  VARIANT (1959): Lys, Ser, Ala, Thr, Gly, or Val
  MOD_RES (1960): Hydroxyproline
  VARIANT (1961): Lys, Ser, Ala, Thr, Gly, or Val
  MOD_RES (1962): Hydroxyproline
  VARIANT (1963): Lys, Ser, Ala, Thr, Gly, or Val
  MOD_RES (1964): Hydroxyproline
  VARIANT (1965): Lys, Ser, Ala, Thr, Gly, or Val
  MOD_RES (1966): Hydroxyproline
  VARIANT (1967): Lys, Ser, Ala, Thr, Gly, or Val
  MOD_RES (1968): Hydroxyproline
  VARIANT (1969): Lys, Ser, Ala, Thr, Gly, or Val
  MOD_RES (1970): Hydroxyproline
  VARIANT (1971): Lys, Ser, Ala, Thr, Gly, or Val
  MOD_RES (1972): Hydroxyproline
  VARIANT (1973): Lys, Ser, Ala, Thr, Gly, or Val
  MOD_RES (1974): Hydroxyproline
  VARIANT (1975): Lys, Ser, Ala, Thr, Gly, or Val
  MOD_RES (1976): Hydroxyproline
  VARIANT (1977): Lys, Ser, Ala, Thr, Gly, or Val
  MOD_RES (1978): Hydroxyproline
  VARIANT (1979): Lys, Ser, Ala, Thr, Gly, or Val
  MOD_RES (1980): Hydroxyproline
  VARIANT (1981): Lys, Ser, Ala, Thr, Gly, or Val
  MOD_RES (1982): Hydroxyproline
  VARIANT (1983): Lys, Ser, Ala, Thr, Gly, or Val
  MOD_RES (1984): Hydroxyproline
  VARIANT (1985): Lys, Ser, Ala, Thr, Gly, or Val
  MOD_RES (1986): Hydroxyproline
  VARIANT (1987): Lys, Ser, Ala, Thr, Gly, or Val
  MOD_RES (1988): Hydroxyproline
  VARIANT (1989): Lys, Ser, Ala, Thr, Gly, or Val
  MOD_RES (1990): Hydroxyproline
  VARIANT (1991): Lys, Ser, Ala, Thr, Gly, or Val
  MOD_RES (1992): Hydroxyproline
  VARIANT (1993): Lys, Ser, Ala, Thr, Gly, or Val
  MOD_RES (1994): Hydroxyproline
  VARIANT (1995): Lys, Ser, Ala, Thr, Gly, or Val
  MOD_RES (1996): Hydroxyproline
  VARIANT (1997): Lys, Ser, Ala, Thr, Gly, or Val
  MOD_RES (1998): Hydroxyproline
  VARIANT (1999): Lys, Ser, Ala, Thr, Gly, or Val
  MOD_RES (2000): Hydroxyproline
  This sequence encompasses at least 1 to 1,000 (Xaa-Hyp) repeating units, and subject to having the minumum number of repeating units, any one or more of the repeating units can either be present or absent
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4 - protein, 20 aa, Artificial Sequence
  Description of Artificial Sequence: Synthetic peptide motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
SXSXSXSXSXSXSXSXSXSX

SEQ ID NO: 5 - protein, 1001 aa, Artificial Sequence
  Description of Artificial Sequence: Synthetic amino acid motif
  VARIANT (1): Lys, Ser, Ala, Thr, Gly, or Val
  VARIANT (2)..(1001): This region encompasses at least 2 to 1,000 residues of Proline, and subject to having the minumum number of residues, any one or more of amino acid residues at positions 2 to 1,001 can either be present or absent
XPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPP

SEQ ID NO: 6 - protein, 2000 aa, Artificial Sequence
  Description of Artificial Sequence: Synthetic amino acid motif
  VARIANT (1)..(1): Lys, Ser, Ala, Thr, Gly, or Val
  VARIANT (3)..(3): Lys, Ser, Ala, Thr, Gly, or Val
  VARIANT (5)..(5): Lys, Ser, Ala, Thr, Gly, or Val
  VARIANT (7)..(7): Lys, Ser, Ala, Thr, Gly, or Val
  VARIANT (9)..(9): Lys, Ser, Ala, Thr, Gly, or Val
  VARIANT (11)..(11): Lys, Ser, Ala, Thr, Gly, or Val
  VARIANT (13)..(13): Lys, Ser, Ala, Thr, Gly, or Val
  VARIANT (15)..(15): Lys, Ser, Ala, Thr, Gly, or Val
  VARIANT (17)..(17): Lys, Ser, Ala, Thr, Gly, or Val
  VARIANT (19)..(19): Lys, Ser, Ala, Thr, Gly, or Val
  VARIANT (21)..(21): Lys, Ser, Ala, Thr, Gly, or Val
  VARIANT (23)..(23): Lys, Ser, Ala, Thr, Gly, or Val
  VARIANT (25)..(25): Lys, Ser, Ala, Thr, Gly, or Val
  VARIANT (27)..(27): Lys, Ser, Ala, Thr, Gly, or Val
  VARIANT (29)..(29): Lys, Ser, Ala, Thr, Gly, or Val
  VARIANT (31)..(31): Lys, Ser, Ala, Thr, Gly, or Val
  VARIANT (33)..(33): Lys, Ser, Ala, Thr, Gly, or Val
  VARIANT (35)..(35): Lys, Ser, Ala, Thr, Gly, or Val
  VARIANT (37)..(37): Lys, Ser, Ala, Thr, Gly, or Val
  VARIANT (39)..(39): Lys, Ser, Ala, Thr, Gly, or Val
  VARIANT (41)..(41): Lys, Ser, Ala, Thr, Gly, or Val
  VARIANT (43)..(43): Lys, Ser, Ala, Thr, Gly, or Val
  VARIANT (45)..(45): Lys, Ser, Ala, Thr, Gly, or Val
  VARIANT (47)..(47): Lys, Ser, Ala, Thr, Gly, or Val
  VARIANT (49)..(49): Lys, Ser, Ala, Thr, Gly, or Val
  VARIANT (51)..(51): Lys, Ser, Ala, Thr, Gly, or Val
  VARIANT (53)..(53): Lys, Ser, Ala, Thr, Gly, or Val
  VARIANT (55)..(55): Lys, Ser, Ala, Thr, Gly, or Val
  VARIANT (57)..(57): Lys, Ser, Ala, Thr, Gly, or Val
  VARIANT (59)..(59): Lys, Ser, Ala, Thr, Gly, or Val
  VARIANT (61)..(61): Lys, Ser, Ala, Thr, Gly, or Val
  VARIANT (63)..(63): Lys, Ser, Ala, Thr, Gly, or Val
  VARIANT (65)..(65): Lys, Ser, Ala, Thr, Gly, or Val
  VARIANT (67)..(67): Lys, Ser, Ala, Thr, Gly, or Val
  VARIANT (69)..(69): Lys, Ser, Ala, Thr, Gly, or Val
  VARIANT (71)..(71): Lys, Ser, Ala, Thr, Gly, or Val
  VARIANT (73)..(73): Lys, Ser, Ala, Thr, Gly, or Val
  VARIANT (75)..(75): Lys, Ser, Ala, Thr, Gly, or Val
  VARIANT (77)..(77): Lys, Ser, Ala, Thr, Gly, or Val
  VARIANT (79)..(79): Lys, Ser, Ala, Thr, Gly, or Val
  VARIANT (81)..(81): Lys, Ser, Ala, Thr, Gly, or Val
  VARIANT (83)..(83): Lys, Ser, Ala, Thr, Gly, or Val
  VARIANT (85)..(85): Lys, Ser, Ala, Thr, Gly, or Val
  VARIANT (87)..(87): Lys, Ser, Ala, Thr, Gly, or Val
  VARIANT (89)..(89): Lys, Ser, Ala, Thr, Gly, or Val
  VARIANT (91)..(91): Lys, Ser, Ala, Thr, Gly, or Val
  VARIANT (93)..(93): Lys, Ser, Ala, Thr, Gly, or Val
  VARIANT (95)..(95): Lys, Ser, Ala, Thr, Gly, or Val
  VARIANT (97)..(97): Lys, Ser, Ala, Thr, Gly, or Val
  VARIANT (99)..(99): Lys, Ser, Ala, Thr, Gly, or Val
  VARIANT (101)..(101): Lys, Ser, Ala, Thr, Gly, or Val
  VARIANT (103)..(103): Lys, Ser, Ala, Thr, Gly, or Val
  VARIANT (105)..(105): Lys, Ser, Ala, Thr, Gly, or Val
  VARIANT (107)..(107): Lys, Ser, Ala, Thr, Gly, or Val
  VARIANT (109)..(109): Lys, Ser, Ala, Thr, Gly, or Val
  VARIANT (111)..(111): Lys, Ser, Ala, Thr, Gly, or Val
  VARIANT (113)..(113): Lys, Ser, Ala, Thr, Gly, or Val
  VARIANT (115)..(115): Lys, Ser, Ala, Thr, Gly, or Val
  VARIANT (117)..(117): Lys, Ser, Ala, Thr, Gly, or Val
  VARIANT (119)..(119): Lys, Ser, Ala, Thr, Gly, or Val
  VARIANT (121)..(121): Lys, Ser, Ala, Thr, Gly, or Val
  VARIANT (123)..(123): Lys, Ser, Ala, Thr, Gly, or Val
  VARIANT (125)..(125): Lys, Ser, Ala, Thr, Gly, or Val
  VARIANT (127)..(127): Lys, Ser, Ala, Thr, Gly, or Val
  VARIANT (129)..(129): Lys, Ser, Ala, Thr, Gly, or Val
  VARIANT (131)..(131): Lys, Ser, Ala, Thr, Gly, or Val
  VARIANT (133)..(133): Lys, Ser, Ala, Thr, Gly, or Val
  VARIANT (135)..(135): Lys, Ser, Ala, Thr, Gly, or Val
  VARIANT (137)..(137): Lys, Ser, Ala, Thr, Gly, or Val
  VARIANT (139)..(139): Lys, Ser, Ala, Thr, Gly, or Val
  VARIANT (141)..(141): Lys, Ser, Ala, Thr, Gly, or Val
  VARIANT (143)..(143): Lys, Ser, Ala, Thr, Gly, or Val
  VARIANT (145)..(145): Lys, Ser, Ala, Thr, Gly, or Val
  VARIANT (147)..(147): Lys, Ser, Ala, Thr, Gly, or Val
  VARIANT (149)..(149): Lys, Ser, Ala, Thr, Gly, or Val
  VARIANT (151)..(151): Lys, Ser, Ala, Thr, Gly, or Val
  VARIANT (153)..(153): Lys, Ser, Ala, Thr, Gly, or Val
  VARIANT (155)..(155): Lys, Ser, Ala, Thr, Gly, or Val
  VARIANT (157)..(157): Lys, Ser, Ala, Thr, Gly, or Val
  VARIANT (159)..(159): Lys, Ser, Ala, Thr, Gly, or Val
  VARIANT (161)..(161): Lys, Ser, Ala, Thr, Gly, or Val
  VARIANT (163)..(163): Lys, Ser, Ala, Thr, Gly, or Val
  VARIANT (165)..(165): Lys, Ser, Ala, Thr, Gly, or Val
  VARIANT (167)..(167): Lys, Ser, Ala, Thr, Gly, or Val
  VARIANT (169)..(169): Lys, Ser, Ala, Thr, Gly, or Val
  VARIANT (171)..(171): Lys, Ser, Ala, Thr, Gly, or Val
  VARIANT (173)..(173): Lys, Ser, Ala, Thr, Gly, or Val
  VARIANT (175)..(175): Lys, Ser, Ala, Thr, Gly, or Val
  VARIANT (177)..(177): Lys, Ser, Ala, Thr, Gly, or Val
  VARIANT (179)..(179): Lys, Ser, Ala, Thr, Gly, or Val
  VARIANT (181)..(181): Lys, Ser, Ala, Thr, Gly, or Val
  VARIANT (183)..(183): Lys, Ser, Ala, Thr, Gly, or Val
  VARIANT (185)..(185): Lys, Ser, Ala, Thr, Gly, or Val
  VARIANT (187)..(187): Lys, Ser, Ala, Thr, Gly, or Val
  VARIANT (189)..(189): Lys, Ser, Ala, Thr, Gly, or Val
  VARIANT (191)..(191): Lys, Ser, Ala, Thr, Gly, or Val
  VARIANT (193)..(193): Lys, Ser, Ala, Thr, Gly, or Val
  VARIANT (195)..(195): Lys, Ser, Ala, Thr, Gly, or Val
  VARIANT (197)..(197): Lys, Ser, Ala, Thr, Gly, or Val
  VARIANT (199)..(199): Lys, Ser, Ala, Thr, Gly, or Val
  VARIANT (201)..(201): Lys, Ser, Ala, Thr, Gly, or Val
  VARIANT (203)..(203): Lys, Ser, Ala, Thr, Gly, or Val
  VARIANT (205)..(205): Lys, Ser, Ala, Thr, Gly, or Val
  VARIANT (207)..(207): Lys, Ser, Ala, Thr, Gly, or Val
  VARIANT (209)..(209): Lys, Ser, Ala, Thr, Gly, or Val
  VARIANT (211)..(211): Lys, Ser, Ala, Thr, Gly, or Val
  VARIANT (213)..(213): Lys, Ser, Ala, Thr, Gly, or Val
  VARIANT (215)..(215): Lys, Ser, Ala, Thr, Gly, or Val
  VARIANT (217)..(217): Lys, Ser, Ala, Thr, Gly, or Val
  VARIANT (219)..(219): Lys, Ser, Ala, Thr, Gly, or Val
  VARIANT (221)..(221): Lys, Ser, Ala, Thr, Gly, or Val
  VARIANT (223)..(223): Lys, Ser, Ala, Thr, Gly, or Val
  VARIANT (225)..(225): Lys, Ser, Ala, Thr, Gly, or Val
  VARIANT (227)..(227): Lys, Ser, Ala, Thr, Gly, or Val
  VARIANT (229)..(229): Lys, Ser, Ala, Thr, Gly, or Val
  VARIANT (231)..(231): Lys, Ser, Ala, Thr, Gly, or Val
  VARIANT (233)..(233): Lys, Ser, Ala, Thr, Gly, or Val
  VARIANT (235)..(235): Lys, Ser, Ala, Thr, Gly, or Val
  VARIANT (237)..(237): Lys, Ser, Ala, Thr, Gly, or Val
  VARIANT (239)..(239): Lys, Ser, Ala, Thr, Gly, or Val
  VARIANT (241)..(241): Lys, Ser, Ala, Thr, Gly, or Val
  VARIANT (243)..(243): Lys, Ser, Ala, Thr, Gly, or Val
  VARIANT (245)..(245): Lys, Ser, Ala, Thr, Gly, or Val
  VARIANT (247)..(247): Lys, Ser, Ala, Thr, Gly, or Val
  VARIANT (249)..(249): Lys, Ser, Ala, Thr, Gly, or Val
  VARIANT (251)..(251): Lys, Ser, Ala, Thr, Gly, or Val
  VARIANT (253)..(253): Lys, Ser, Ala, Thr, Gly, or Val
  VARIANT (255)..(255): Lys, Ser, Ala, Thr, Gly, or Val
  VARIANT (257)..(257): Lys, Ser, Ala, Thr, Gly, or Val
  VARIANT (259)..(259): Lys, Ser, Ala, Thr, Gly, or Val
  VARIANT (261)..(261): Lys, Ser, Ala, Thr, Gly, or Val
  VARIANT (263)..(263): Lys, Ser, Ala, Thr, Gly, or Val
  VARIANT (265)..(265): Lys, Ser, Ala, Thr, Gly, or Val
  VARIANT (267)..(267): Lys, Ser, Ala, Thr, Gly, or Val
  VARIANT (269)..(269): Lys, Ser, Ala, Thr, Gly, or Val
  VARIANT (271)..(271): Lys, Ser, Ala, Thr, Gly, or Val
  VARIANT (273)..(273): Lys, Ser, Ala, Thr, Gly, or Val
  VARIANT (275)..(275): Lys, Ser, Ala, Thr, Gly, or Val
  VARIANT (277)..(277): Lys, Ser, Ala, Thr, Gly, or Val
  VARIANT (279)..(279): Lys, Ser, Ala, Thr, Gly, or Val
  VARIANT (281)..(281): Lys, Ser, Ala, Thr, Gly, or Val
  VARIANT (283)..(283): Lys, Ser, Ala, Thr, Gly, or Val
  VARIANT (285)..(285): Lys, Ser, Ala, Thr, Gly, or Val
  VARIANT (287)..(287): Lys, Ser, Ala, Thr, Gly, or Val
  VARIANT (289)..(289): Lys, Ser, Ala, Thr, Gly, or Val
  VARIANT (291)..(291): Lys, Ser, Ala, Thr, Gly, or Val
  VARIANT (293)..(293): Lys, Ser, Ala, Thr, Gly, or Val
  VARIANT (295)..(295): Lys, Ser, Ala, Thr, Gly, or Val
  VARIANT (297)..(297): Lys, Ser, Ala, Thr, Gly, or Val
  VARIANT (299)..(299): Lys, Ser, Ala, Thr, Gly, or Val
  VARIANT (301)..(301): Lys, Ser, Ala, Thr, Gly, or Val
  VARIANT (303)..(303): Lys, Ser, Ala, Thr, Gly, or Val
  VARIANT (305)..(305): Lys, Ser, Ala, Thr, Gly, or Val
  VARIANT (307)..(307): Lys, Ser, Ala, Thr, Gly, or Val
  VARIANT (309)..(309): Lys, Ser, Ala, Thr, Gly, or Val
  VARIANT (311)..(311): Lys, Ser, Ala, Thr, Gly, or Val
  VARIANT (313)..(313): Lys, Ser, Ala, Thr, Gly, or Val
  VARIANT (315)..(315): Lys, Ser, Ala, Thr, Gly, or Val
  VARIANT (317)..(317): Lys, Ser, Ala, Thr, Gly, or Val
  VARIANT (319)..(319): Lys, Ser, Ala, Thr, Gly, or Val
  VARIANT (321)..(321): Lys, Ser, Ala, Thr, Gly, or Val
  VARIANT (323)..(323): Lys, Ser, Ala, Thr, Gly, or Val
  VARIANT (325)..(325): Lys, Ser, Ala, Thr, Gly, or Val
  VARIANT (327)..(327): Lys, Ser, Ala, Thr, Gly, or Val
  VARIANT (329)..(329): Lys, Ser, Ala, Thr, Gly, or Val
  VARIANT (331)..(331): Lys, Ser, Ala, Thr, Gly, or Val
  VARIANT (333)..(333): Lys, Ser, Ala, Thr, Gly, or Val
  VARIANT (335)..(335): Lys, Ser, Ala, Thr, Gly, or Val
  VARIANT (337)..(337): Lys, Ser, Ala, Thr, Gly, or Val
  VARIANT (339)..(339): Lys, Ser, Ala, Thr, Gly, or Val
  VARIANT (341)..(341): Lys, Ser, Ala, Thr, Gly, or Val
  VARIANT (343)..(343): Lys, Ser, Ala, Thr, Gly, or Val
  VARIANT (345)..(345): Lys, Ser, Ala, Thr, Gly, or Val
  VARIANT (347)..(347): Lys, Ser, Ala, Thr, Gly, or Val
  VARIANT (349)..(349): Lys, Ser, Ala, Thr, Gly, or Val
  VARIANT (351)..(351): Lys, Ser, Ala, Thr, Gly, or Val
  VARIANT (353)..(353): Lys, Ser, Ala, Thr, Gly, or Val
  VARIANT (355)..(355): Lys, Ser, Ala, Thr, Gly, or Val
  VARIANT (357)..(357): Lys, Ser, Ala, Thr, Gly, or Val
  VARIANT (359)..(359): Lys, Ser, Ala, Thr, Gly, or Val
  VARIANT (361)..(361): Lys, Ser, Ala, Thr, Gly, or Val
  VARIANT (363)..(363): Lys, Ser, Ala, Thr, Gly, or Val
  VARIANT (365)..(365): Lys, Ser, Ala, Thr, Gly, or Val
  VARIANT (367)..(367): Lys, Ser, Ala, Thr, Gly, or Val
  VARIANT (369)..(369): Lys, Ser, Ala, Thr, Gly, or Val
  VARIANT (371)..(371): Lys, Ser, Ala, Thr, Gly, or Val
  VARIANT (373)..(373): Lys, Ser, Ala, Thr, Gly, or Val
  VARIANT (375)..(375): Lys, Ser, Ala, Thr, Gly, or Val
  VARIANT (377)..(377): Lys, Ser, Ala, Thr, Gly, or Val
  VARIANT (379)..(379): Lys, Ser, Ala, Thr, Gly, or Val
  VARIANT (381)..(381): Lys, Ser, Ala, Thr, Gly, or Val
  VARIANT (383)..(383): Lys, Ser, Ala, Thr, Gly, or Val
  VARIANT (385)..(385): Lys, Ser, Ala, Thr, Gly, or Val
  VARIANT (387)..(387): Lys, Ser, Ala, Thr, Gly, or Val
  VARIANT (389)..(389): Lys, Ser, Ala, Thr, Gly, or Val
  VARIANT (391)..(391): Lys, Ser, Ala, Thr, Gly, or Val
  VARIANT (393)..(393): Lys, Ser, Ala, Thr, Gly, or Val
  VARIANT (395)..(395): Lys, Ser, Ala, Thr, Gly, or Val
  VARIANT (397)..(397): Lys, Ser, Ala, Thr, Gly, or Val
  VARIANT (399)..(399): Lys, Ser, Ala, Thr, Gly, or Val
  VARIANT (401)..(401): Lys, Ser, Ala, Thr, Gly, or Val
  VARIANT (403)..(403): Lys, Ser, Ala, Thr, Gly, or Val
  VARIANT (405)..(405): Lys, Ser, Ala, Thr, Gly, or Val
  VARIANT (407)..(407): Lys, Ser, Ala, Thr, Gly, or Val
  VARIANT (409)..(409): Lys, Ser, Ala, Thr, Gly, or Val
  VARIANT (411)..(411): Lys, Ser, Ala, Thr, Gly, or Val
  VARIANT (413)..(413): Lys, Ser, Ala, Thr, Gly, or Val
  VARIANT (415)..(415): Lys, Ser, Ala, Thr, Gly, or Val
  VARIANT (417)..(417): Lys, Ser, Ala, Thr, Gly, or Val
  VARIANT (419)..(419): Lys, Ser, Ala, Thr, Gly, or Val
  VARIANT (421)..(421): Lys, Ser, Ala, Thr, Gly, or Val
  VARIANT (423)..(423): Lys, Ser, Ala, Thr, Gly, or Val
  VARIANT (425)..(425): Lys, Ser, Ala, Thr, Gly, or Val
  VARIANT (427)..(427): Lys, Ser, Ala, Thr, Gly, or Val
  VARIANT (429)..(429): Lys, Ser, Ala, Thr, Gly, or Val
  VARIANT (431)..(431): Lys, Ser, Ala, Thr, Gly, or Val
  VARIANT (433)..(433): Lys, Ser, Ala, Thr, Gly, or Val
  VARIANT (435)..(435): Lys, Ser, Ala, Thr, Gly, or Val
  VARIANT (437)..(437): Lys, Ser, Ala, Thr, Gly, or Val
  VARIANT (439)..(439): Lys, Ser, Ala, Thr, Gly, or Val
  VARIANT (441)..(441): Lys, Ser, Ala, Thr, Gly, or Val
  VARIANT (443)..(443): Lys, Ser, Ala, Thr, Gly, or Val
  VARIANT (445)..(445): Lys, Ser, Ala, Thr, Gly, or Val
  VARIANT (447)..(447): Lys, Ser, Ala, Thr, Gly, or Val
  VARIANT (449)..(449): Lys, Ser, Ala, Thr, Gly, or Val
  VARIANT (451)..(451): Lys, Ser, Ala, Thr, Gly, or Val
  VARIANT (453)..(453): Lys, Ser, Ala, Thr, Gly, or Val
  VARIANT (455)..(455): Lys, Ser, Ala, Thr, Gly, or Val
  VARIANT (457)..(457): Lys, Ser, Ala, Thr, Gly, or Val
  VARIANT (459)..(459): Lys, Ser, Ala, Thr, Gly, or Val
  VARIANT (461)..(461): Lys, Ser, Ala, Thr, Gly, or Val
  VARIANT (463)..(463): Lys, Ser, Ala, Thr, Gly, or Val
  VARIANT (465)..(465): Lys, Ser, Ala, Thr, Gly, or Val
  VARIANT (467)..(467): Lys, Ser, Ala, Thr, Gly, or Val
  VARIANT (469)..(469): Lys, Ser, Ala, Thr, Gly, or Val
  VARIANT (471)..(471): Lys, Ser, Ala, Thr, Gly, or Val
  VARIANT (473)..(473): Lys, Ser, Ala, Thr, Gly, or Val
  VARIANT (475)..(475): Lys, Ser, Ala, Thr, Gly, or Val
  VARIANT (477)..(477): Lys, Ser, Ala, Thr, Gly, or Val
  VARIANT (479)..(479): Lys, Ser, Ala, Thr, Gly, or Val
  VARIANT (481)..(481): Lys, Ser, Ala, Thr, Gly, or Val
  VARIANT (483)..(483): Lys, Ser, Ala, Thr, Gly, or Val
  VARIANT (485)..(485): Lys, Ser, Ala, Thr, Gly, or Val
  VARIANT (487)..(487): Lys, Ser, Ala, Thr, Gly, or Val
  VARIANT (489)..(489): Lys, Ser, Ala, Thr, Gly, or Val
  VARIANT (491)..(491): Lys, Ser, Ala, Thr, Gly, or Val
  VARIANT (493)..(493): Lys, Ser, Ala, Thr, Gly, or Val
  VARIANT (495)..(495): Lys, Ser, Ala, Thr, Gly, or Val
  VARIANT (497)..(497): Lys, Ser, Ala, Thr, Gly, or Val
  VARIANT (499)..(499): Lys, Ser, Ala, Thr, Gly, or Val
  VARIANT (501)..(501): Lys, Ser, Ala, Thr, Gly, or Val
  VARIANT (503)..(503): Lys, Ser, Ala, Thr, Gly, or Val
  VARIANT (505)..(505): Lys, Ser, Ala, Thr, Gly, or Val
  VARIANT (507)..(507): Lys, Ser, Ala, Thr, Gly, or Val
  VARIANT (509)..(509): Lys, Ser, Ala, Thr, Gly, or Val
  VARIANT (511)..(511): Lys, Ser, Ala, Thr, Gly, or Val
  VARIANT (513)..(513): Lys, Ser, Ala, Thr, Gly, or Val
  VARIANT (515)..(515): Lys, Ser, Ala, Thr, Gly, or Val
  VARIANT (517)..(517): Lys, Ser, Ala, Thr, Gly, or Val
  VARIANT (519)..(519): Lys, Ser, Ala, Thr, Gly, or Val
  VARIANT (521)..(521): Lys, Ser, Ala, Thr, Gly, or Val
  VARIANT (523)..(523): Lys, Ser, Ala, Thr, Gly, or Val
  VARIANT (525)..(525): Lys, Ser, Ala, Thr, Gly, or Val
  VARIANT (527)..(527): Lys, Ser, Ala, Thr, Gly, or Val
  VARIANT (529)..(529): Lys, Ser, Ala, Thr, Gly, or Val
  VARIANT (531)..(531): Lys, Ser, Ala, Thr, Gly, or Val
  VARIANT (533)..(533): Lys, Ser, Ala, Thr, Gly, or Val
  VARIANT (535)..(535): Lys, Ser, Ala, Thr, Gly, or Val
  VARIANT (537)..(537): Lys, Ser, Ala, Thr, Gly, or Val
  VARIANT (539)..(539): Lys, Ser, Ala, Thr, Gly, or Val
  VARIANT (541)..(541): Lys, Ser, Ala, Thr, Gly, or Val
  VARIANT (543)..(543): Lys, Ser, Ala, Thr, Gly, or Val
  VARIANT (545)..(545): Lys, Ser, Ala, Thr, Gly, or Val
  VARIANT (547)..(547): Lys, Ser, Ala, Thr, Gly, or Val
  VARIANT (549)..(549): Lys, Ser, Ala, Thr, Gly, or Val
  VARIANT (551)..(551): Lys, Ser, Ala, Thr, Gly, or Val
  VARIANT (553)..(553): Lys, Ser, Ala, Thr, Gly, or Val
  VARIANT (555)..(555): Lys, Ser, Ala, Thr, Gly, or Val
  VARIANT (557)..(557): Lys, Ser, Ala, Thr, Gly, or Val
  VARIANT (559)..(559): Lys, Ser, Ala, Thr, Gly, or Val
  VARIANT (561)..(561): Lys, Ser, Ala, Thr, Gly, or Val
  VARIANT (563)..(563): Lys, Ser, Ala, Thr, Gly, or Val
  VARIANT (565)..(565): Lys, Ser, Ala, Thr, Gly, or Val
  VARIANT (567)..(567): Lys, Ser, Ala, Thr, Gly, or Val
  VARIANT (569)..(569): Lys, Ser, Ala, Thr, Gly, or Val
  VARIANT (571)..(571): Lys, Ser, Ala, Thr, Gly, or Val
  VARIANT (573)..(573): Lys, Ser, Ala, Thr, Gly, or Val
  VARIANT (575)..(575): Lys, Ser, Ala, Thr, Gly, or Val
  VARIANT (577)..(577): Lys, Ser, Ala, Thr, Gly, or Val
  VARIANT (579)..(579): Lys, Ser, Ala, Thr, Gly, or Val
  VARIANT (581)..(581): Lys, Ser, Ala, Thr, Gly, or Val
  VARIANT (583)..(583): Lys, Ser, Ala, Thr, Gly, or Val
  VARIANT (585)..(585): Lys, Ser, Ala, Thr, Gly, or Val
  VARIANT (587)..(587): Lys, Ser, Ala, Thr, Gly, or Val
  VARIANT (589)..(589): Lys, Ser, Ala, Thr, Gly, or Val
  VARIANT (591)..(591): Lys, Ser, Ala, Thr, Gly, or Val
  VARIANT (593)..(593): Lys, Ser, Ala, Thr, Gly, or Val
  VARIANT (595)..(595): Lys, Ser, Ala, Thr, Gly, or Val
  VARIANT (597)..(597): Lys, Ser, Ala, Thr, Gly, or Val
  VARIANT (599)..(599): Lys, Ser, Ala, Thr, Gly, or Val
  VARIANT (601)..(601): Lys, Ser, Ala, Thr, Gly, or Val
  VARIANT (603)..(603): Lys, Ser, Ala, Thr, Gly, or Val
  VARIANT (605)..(605): Lys, Ser, Ala, Thr, Gly, or Val
  VARIANT (607)..(607): Lys, Ser, Ala, Thr, Gly, or Val
  VARIANT (609)..(609): Lys, Ser, Ala, Thr, Gly, or Val
  VARIANT (611)..(611): Lys, Ser, Ala, Thr, Gly, or Val
  VARIANT (613)..(613): Lys, Ser, Ala, Thr, Gly, or Val
  VARIANT (615)..(615): Lys, Ser, Ala, Thr, Gly, or Val
  VARIANT (617)..(617): Lys, Ser, Ala, Thr, Gly, or Val
  VARIANT (619)..(619): Lys, Ser, Ala, Thr, Gly, or Val
  VARIANT (621)..(621): Lys, Ser, Ala, Thr, Gly, or Val
  VARIANT (623)..(623): Lys, Ser, Ala, Thr, Gly, or Val
  VARIANT (625)..(625): Lys, Ser, Ala, Thr, Gly, or Val
  VARIANT (627)..(627): Lys, Ser, Ala, Thr, Gly, or Val
  VARIANT (629)..(629): Lys, Ser, Ala, Thr, Gly, or Val
  VARIANT (631)..(631): Lys, Ser, Ala, Thr, Gly, or Val
  VARIANT (633)..(633): Lys, Ser, Ala, Thr, Gly, or Val
  VARIANT (635)..(635): Lys, Ser, Ala, Thr, Gly, or Val
  VARIANT (637)..(637): Lys, Ser, Ala, Thr, Gly, or Val
  VARIANT (639)..(639): Lys, Ser, Ala, Thr, Gly, or Val
  VARIANT (641)..(641): Lys, Ser, Ala, Thr, Gly, or Val
  VARIANT (643)..(643): Lys, Ser, Ala, Thr, Gly, or Val
  VARIANT (645)..(645): Lys, Ser, Ala, Thr, Gly, or Val
  VARIANT (647)..(647): Lys, Ser, Ala, Thr, Gly, or Val
  VARIANT (649)..(649): Lys, Ser, Ala, Thr, Gly, or Val
  VARIANT (651)..(651): Lys, Ser, Ala, Thr, Gly, or Val
  VARIANT (653)..(653): Lys, Ser, Ala, Thr, Gly, or Val
  VARIANT (655)..(655): Lys, Ser, Ala, Thr, Gly, or Val
  VARIANT (657)..(657): Lys, Ser, Ala, Thr, Gly, or Val
  VARIANT (659)..(659): Lys, Ser, Ala, Thr, Gly, or Val
  VARIANT (661)..(661): Lys, Ser, Ala, Thr, Gly, or Val
  VARIANT (663)..(663): Lys, Ser, Ala, Thr, Gly, or Val
  VARIANT (665)..(665): Lys, Ser, Ala, Thr, Gly, or Val
  VARIANT (667)..(667): Lys, Ser, Ala, Thr, Gly, or Val
  VARIANT (669)..(669): Lys, Ser, Ala, Thr, Gly, or Val
  VARIANT (671)..(671): Lys, Ser, Ala, Thr, Gly, or Val
  VARIANT (673)..(673): Lys, Ser, Ala, Thr, Gly, or Val
  VARIANT (675)..(675): Lys, Ser, Ala, Thr, Gly, or Val
  VARIANT (677)..(677): Lys, Ser, Ala, Thr, Gly, or Val
  VARIANT (679)..(679): Lys, Ser, Ala, Thr, Gly, or Val
  VARIANT (681)..(681): Lys, Ser, Ala, Thr, Gly, or Val
  VARIANT (683)..(683): Lys, Ser, Ala, Thr, Gly, or Val
  VARIANT (685)..(685): Lys, Ser, Ala, Thr, Gly, or Val
  VARIANT (687)..(687): Lys, Ser, Ala, Thr, Gly, or Val
  VARIANT (689)..(689): Lys, Ser, Ala, Thr, Gly, or Val
  VARIANT (691)..(691): Lys, Ser, Ala, Thr, Gly, or Val
  VARIANT (693)..(693): Lys, Ser, Ala, Thr, Gly, or Val
  VARIANT (695)..(695): Lys, Ser, Ala, Thr, Gly, or Val
  VARIANT (697)..(697): Lys, Ser, Ala, Thr, Gly, or Val
  VARIANT (699)..(699): Lys, Ser, Ala, Thr, Gly, or Val
  VARIANT (701)..(701): Lys, Ser, Ala, Thr, Gly, or Val
  VARIANT (703)..(703): Lys, Ser, Ala, Thr, Gly, or Val
  VARIANT (705)..(705): Lys, Ser, Ala, Thr, Gly, or Val
  VARIANT (707)..(707): Lys, Ser, Ala, Thr, Gly, or Val
  VARIANT (709)..(709): Lys, Ser, Ala, Thr, Gly, or Val
  VARIANT (711)..(711): Lys, Ser, Ala, Thr, Gly, or Val
  VARIANT (713)..(713): Lys, Ser, Ala, Thr, Gly, or Val
  VARIANT (715)..(715): Lys, Ser, Ala, Thr, Gly, or Val
  VARIANT (717)..(717): Lys, Ser, Ala, Thr, Gly, or Val
  VARIANT (719)..(719): Lys, Ser, Ala, Thr, Gly, or Val
  VARIANT (721)..(721): Lys, Ser, Ala, Thr, Gly, or Val
  VARIANT (723)..(723): Lys, Ser, Ala, Thr, Gly, or Val
  VARIANT (725)..(725): Lys, Ser, Ala, Thr, Gly, or Val
  VARIANT (727)..(727): Lys, Ser, Ala, Thr, Gly, or Val
  VARIANT (729)..(729): Lys, Ser, Ala, Thr, Gly, or Val
  VARIANT (731)..(731): Lys, Ser, Ala, Thr, Gly, or Val
  VARIANT (733)..(733): Lys, Ser, Ala, Thr, Gly, or Val
  VARIANT (735)..(735): Lys, Ser, Ala, Thr, Gly, or Val
  VARIANT (737)..(737): Lys, Ser, Ala, Thr, Gly, or Val
  VARIANT (739)..(739): Lys, Ser, Ala, Thr, Gly, or Val
  VARIANT (741)..(741): Lys, Ser, Ala, Thr, Gly, or Val
  VARIANT (743)..(743): Lys, Ser, Ala, Thr, Gly, or Val
  VARIANT (745)..(745): Lys, Ser, Ala, Thr, Gly, or Val
  VARIANT (747)..(747): Lys, Ser, Ala, Thr, Gly, or Val
  VARIANT (749)..(749): Lys, Ser, Ala, Thr, Gly, or Val
  VARIANT (751)..(751): Lys, Ser, Ala, Thr, Gly, or Val
  VARIANT (753)..(753): Lys, Ser, Ala, Thr, Gly, or Val
  VARIANT (755)..(755): Lys, Ser, Ala, Thr, Gly, or Val
  VARIANT (757)..(757): Lys, Ser, Ala, Thr, Gly, or Val
  VARIANT (759)..(759): Lys, Ser, Ala, Thr, Gly, or Val
  VARIANT (761)..(761): Lys, Ser, Ala, Thr, Gly, or Val
  VARIANT (763)..(763): Lys, Ser, Ala, Thr, Gly, or Val
  VARIANT (765)..(765): Lys, Ser, Ala, Thr, Gly, or Val
  VARIANT (767)..(767): Lys, Ser, Ala, Thr, Gly, or Val
  VARIANT (769)..(769): Lys, Ser, Ala, Thr, Gly, or Val
  VARIANT (771)..(771): Lys, Ser, Ala, Thr, Gly, or Val
  VARIANT (773)..(773): Lys, Ser, Ala, Thr, Gly, or Val
  VARIANT (775)..(775): Lys, Ser, Ala, Thr, Gly, or Val
  VARIANT (777)..(777): Lys, Ser, Ala, Thr, Gly, or Val
  VARIANT (779)..(779): Lys, Ser, Ala, Thr, Gly, or Val
  VARIANT (781)..(781): Lys, Ser, Ala, Thr, Gly, or Val
  VARIANT (783)..(783): Lys, Ser, Ala, Thr, Gly, or Val
  VARIANT (785)..(785): Lys, Ser, Ala, Thr, Gly, or Val
  VARIANT (787)..(787): Lys, Ser, Ala, Thr, Gly, or Val
  VARIANT (789)..(789): Lys, Ser, Ala, Thr, Gly, or Val
  VARIANT (791)..(791): Lys, Ser, Ala, Thr, Gly, or Val
  VARIANT (793)..(793): Lys, Ser, Ala, Thr, Gly, or Val
  VARIANT (795)..(795): Lys, Ser, Ala, Thr, Gly, or Val
  VARIANT (797)..(797): Lys, Ser, Ala, Thr, Gly, or Val
  VARIANT (799)..(799): Lys, Ser, Ala, Thr, Gly, or Val
  VARIANT (801)..(801): Lys, Ser, Ala, Thr, Gly, or Val
  VARIANT (803)..(803): Lys, Ser, Ala, Thr, Gly, or Val
  VARIANT (805)..(805): Lys, Ser, Ala, Thr, Gly, or Val
  VARIANT (807)..(807): Lys, Ser, Ala, Thr, Gly, or Val
  VARIANT (809)..(809): Lys, Ser, Ala, Thr, Gly, or Val
  VARIANT (811)..(811): Lys, Ser, Ala, Thr, Gly, or Val
  VARIANT (813)..(813): Lys, Ser, Ala, Thr, Gly, or Val
  VARIANT (815)..(815): Lys, Ser, Ala, Thr, Gly, or Val
  VARIANT (817)..(817): Lys, Ser, Ala, Thr, Gly, or Val
  VARIANT (819)..(819): Lys, Ser, Ala, Thr, Gly, or Val
  VARIANT (821)..(821): Lys, Ser, Ala, Thr, Gly, or Val
  VARIANT (823)..(823): Lys, Ser, Ala, Thr, Gly, or Val
  VARIANT (825)..(825): Lys, Ser, Ala, Thr, Gly, or Val
  VARIANT (827)..(827): Lys, Ser, Ala, Thr, Gly, or Val
  VARIANT (829)..(829): Lys, Ser, Ala, Thr, Gly, or Val
  VARIANT (831)..(831): Lys, Ser, Ala, Thr, Gly, or Val
  VARIANT (833)..(833): Lys, Ser, Ala, Thr, Gly, or Val
  VARIANT (835)..(835): Lys, Ser, Ala, Thr, Gly, or Val
  VARIANT (837)..(837): Lys, Ser, Ala, Thr, Gly, or Val
  VARIANT (839)..(839): Lys, Ser, Ala, Thr, Gly, or Val
  VARIANT (841)..(841): Lys, Ser, Ala, Thr, Gly, or Val
  VARIANT (843)..(843): Lys, Ser, Ala, Thr, Gly, or Val
  VARIANT (845)..(845): Lys, Ser, Ala, Thr, Gly, or Val
  VARIANT (847)..(847): Lys, Ser, Ala, Thr, Gly, or Val
  VARIANT (849)..(849): Lys, Ser, Ala, Thr, Gly, or Val
  VARIANT (851)..(851): Lys, Ser, Ala, Thr, Gly, or Val
  VARIANT (853)..(853): Lys, Ser, Ala, Thr, Gly, or Val
  VARIANT (855)..(855): Lys, Ser, Ala, Thr, Gly, or Val
  VARIANT (857)..(857): Lys, Ser, Ala, Thr, Gly, or Val
  VARIANT (859)..(859): Lys, Ser, Ala, Thr, Gly, or Val
  VARIANT (861)..(861): Lys, Ser, Ala, Thr, Gly, or Val
  VARIANT (863)..(863): Lys, Ser, Ala, Thr, Gly, or Val
  VARIANT (865)..(865): Lys, Ser, Ala, Thr, Gly, or Val
  VARIANT (867)..(867): Lys, Ser, Ala, Thr, Gly, or Val
  VARIANT (869)..(869): Lys, Ser, Ala, Thr, Gly, or Val
  VARIANT (871)..(871): Lys, Ser, Ala, Thr, Gly, or Val
  VARIANT (873)..(873): Lys, Ser, Ala, Thr, Gly, or Val
  VARIANT (875)..(875): Lys, Ser, Ala, Thr, Gly, or Val
  VARIANT (877)..(877): Lys, Ser, Ala, Thr, Gly, or Val
  VARIANT (879)..(879): Lys, Ser, Ala, Thr, Gly, or Val
  VARIANT (881)..(881): Lys, Ser, Ala, Thr, Gly, or Val
  VARIANT (883)..(883): Lys, Ser, Ala, Thr, Gly, or Val
  VARIANT (885)..(885): Lys, Ser, Ala, Thr, Gly, or Val
  VARIANT (887)..(887): Lys, Ser, Ala, Thr, Gly, or Val
  VARIANT (889)..(889): Lys, Ser, Ala, Thr, Gly, or Val
  VARIANT (891)..(891): Lys, Ser, Ala, Thr, Gly, or Val
  VARIANT (893)..(893): Lys, Ser, Ala, Thr, Gly, or Val
  VARIANT (895)..(895): Lys, Ser, Ala, Thr, Gly, or Val
  vARIANT (897)..(897): Lys, Ser, Ala, Thr, Gly, or Val
  VARIANT (899)..(899): Lys, Ser, Ala, Thr, Gly, or Val
  VARIANT (901)..(901): Lys, Ser, Ala, Thr, Gly, or Val
  VARIANT (903)..(903): Lys, Ser, Ala, Thr, Gly, or Val
  VARIANT (905)..(905): Lys, Ser, Ala, Thr, Gly, or Val
  VARIANT (907)..(907): Lys, Ser, Ala, Thr, Gly, or Val
  VARIANT (909)..(909): Lys, Ser, Ala, Thr, Gly, or Val
  VARIANT (911)..(911): Lys, Ser, Ala, Thr, Gly, or Val
  VARIANT (913)..(913): Lys, Ser, Ala, Thr, Gly, or Val
  VARIANT (915)..(915): Lys, Ser, Ala, Thr, Gly, or Val
  VARIANT (917)..(917): Lys, Ser, Ala, Thr, Gly, or Val
  VARIANT (919)..(919): Lys, Ser, Ala, Thr, Gly, or Val
  VARIANT (921)..(921): Lys, Ser, Ala, Thr, Gly, or Val
  VARIANT (923)..(923): Lys, Ser, Ala, Thr, Gly, or Val
  VARIANT (925)..(925): Lys, Ser, Ala, Thr, Gly, or Val
  VARIANT (927)..(927): Lys, Ser, Ala, Thr, Gly, or Val
  VARIANT (929)..(929): Lys, Ser, Ala, Thr, Gly, or Val
  VARIANT (931)..(931): Lys, Ser, Ala, Thr, Gly, or Val
  VARIANT (933)..(933): Lys, Ser, Ala, Thr, Gly, or Val
  VARIANT (935)..(935): Lys, Ser, Ala, Thr, Gly, or Val
  VARIANT (937)..(937): Lys, Ser, Ala, Thr, Gly, or Val
  VARIANT (939)..(939): Lys, Ser, Ala, Thr, Gly, or Val
  VARIANT (941)..(941): Lys, Ser, Ala, Thr, Gly, or Val
  VARIANT (943)..(943): Lys, Ser, Ala, Thr, Gly, or Val
  VARIANT (945)..(945): Lys, Ser, Ala, Thr, Gly, or Val
  VARIANT (947)..(947): Lys, Ser, Ala, Thr, Gly, or Val
  VARIANT (949)..(949): Lys, Ser, Ala, Thr, Gly, or Val
  VARIANT (951)..(951): Lys, Ser, Ala, Thr, Gly, or Val
  VARIANT (953)..(953): Lys, Ser, Ala, Thr, Gly, or Val
  VARIANT (955)..(955): Lys, Ser, Ala, Thr, Gly, or Val
  VARIANT (957)..(957): Lys, Ser, Ala, Thr, Gly, or Val
  VARIANT (959)..(959): Lys, Ser, Ala, Thr, Gly, or Val
  VARIANT (961)..(961): Lys, Ser, Ala, Thr, Gly, or Val
  VARIANT (963)..(963): Lys, Ser, Ala, Thr, Gly, or Val
  VARIANT (965)..(965): Lys, Ser, Ala, Thr, Gly, or Val
  VARIANT (967)..(967): Lys, Ser, Ala, Thr, Gly, or Val
  VARIANT (969)..(969): Lys, Ser, Ala, Thr, Gly, or Val
  VARIANT (971)..(971): Lys, Ser, Ala, Thr, Gly, or Val
  VARIANT (973)..(973): Lys, Ser, Ala, Thr, Gly, or Val
  VARIANT (975)..(975): Lys, Ser, Ala, Thr, Gly, or Val
  VARIANT (977)..(977): Lys, Ser, Ala, Thr, Gly, or Val
  VARIANT (979)..(979): Lys, Ser, Ala, Thr, Gly, or Val
  VARIANT (981)..(981): Lys, Ser, Ala, Thr, Gly, or Val
  VARIANT (983)..(983): Lys, Ser, Ala, Thr, Gly, or Val
  VARIANT (985)..(985): Lys, Ser, Ala, Thr, Gly, or Val
  VARIANT (987)..(987): Lys, Ser, Ala, Thr, Gly, or Val
  VARIANT (989)..(989): Lys, Ser, Ala, Thr, Gly, or Val
  VARIANT (991)..(991): Lys, Ser, Ala, Thr, Gly, or Val
  VARIANT (993)..(993): Lys, Ser, Ala, Thr, Gly, or Val
  VARIANT (995)..(995): Lys, Ser, Ala, Thr, Gly, or Val
  VARIANT (997)..(997): Lys, Ser, Ala, Thr, Gly, or Val
  VARIANT (999)..(999): Lys, Ser, Ala, Thr, Gly, or Val
  VARIANT (1001)..(1001): Lys, Ser, Ala, Thr, Gly, or Val
  VARIANT (1003)..(1003): Lys, Ser, Ala, Thr, Gly, or Val
  VARIANT (1005)..(1005): Lys, Ser, Ala, Thr, Gly, or Val
  VARIANT (1007)..(1007): Lys, Ser, Ala, Thr, Gly, or Val
  VARIANT (1009)..(1009): Lys, Ser, Ala, Thr, Gly, or Val
  VARIANT (1011)..(1011): Lys, Ser, Ala, Thr, Gly, or Val
  VARIANT (1013)..(1013): Lys, Ser, Ala, Thr, Gly, or Val
  VARIANT (1015)..(1015): Lys, Ser, Ala, Thr, Gly, or Val
  VARIANT (1017)..(1017): Lys, Ser, Ala, Thr, Gly, or Val
  VARIANT (1019)..(1019): Lys, Ser, Ala, Thr, Gly, or Val
  VARIANT (1021)..(1021): Lys, Ser, Ala, Thr, Gly, or Val
  VARIANT (1023)..(1023): Lys, Ser, Ala, Thr, Gly, or Val
  VARIANT (1025)..(1025): Lys, Ser, Ala, Thr, Gly, or Val
  VARIANT (1027)..(1027): Lys, Ser, Ala, Thr, Gly, or Val
  VARIANT (1029)..(1029): Lys, Ser, Ala, Thr, Gly, or Val
  VARIANT (1031)..(1031): Lys, Ser, Ala, Thr, Gly, or Val
  VARIANT (1033)..(1033): Lys, Ser, Ala, Thr, Gly, or Val
  VARIANT (1035)..(1035): Lys, Ser, Ala, Thr, Gly, or Val
  VARIANT (1037)..(1037): Lys, Ser, Ala, Thr, Gly, or Val
  VARIANT (1039)..(1039): Lys, Ser, Ala, Thr, Gly, or Val
  VARIANT (1041)..(1041): Lys, Ser, Ala, Thr, Gly, or Val
  VARIANT (1043)..(1043): Lys, Ser, Ala, Thr, Gly, or Val
  VARIANT (1045)..(1045): Lys, Ser, Ala, Thr, Gly, or Val
  VARIANT (1047)..(1047): Lys, Ser, Ala, Thr, Gly, or Val
  VARIANT (1049)..(1049): Lys, Ser, Ala, Thr, Gly, or Val
  VARIANT (1051)..(1051): Lys, Ser, Ala, Thr, Gly, or Val
  VARIANT (1053)..(1053): Lys, Ser, Ala, Thr, Gly, or Val
  VARIANT (1055)..(1055): Lys, Ser, Ala, Thr, Gly, or Val
  VARIANT (1057)..(1057): Lys, Ser, Ala, Thr, Gly, or Val
  VARIANT (1059)..(1059): Lys, Ser, Ala, Thr, Gly, or Val
  VARIANT (1061)..(1061): Lys, Ser, Ala, Thr, Gly, or Val
  VARIANT (1063)..(1063): Lys, Ser, Ala, Thr, Gly, or Val
  VARIANT (1065)..(1065): Lys, Ser, Ala, Thr, Gly, or Val
  VARIANT (1067)..(1067): Lys, Ser, Ala, Thr, Gly, or Val
  VARIANT (1069)..(1069): Lys, Ser, Ala, Thr, Gly, or Val
  VARIANT (1071)..(1071): Lys, Ser, Ala, Thr, Gly, or Val
  VARIANT (1073)..(1073): Lys, Ser, Ala, Thr, Gly, or Val
  VARIANT (1075)..(1075): Lys, Ser, Ala, Thr, Gly, or Val
  VARIANT (1077)..(1077): Lys, Ser, Ala, Thr, Gly, or Val
  VARIANT (1079)..(1079): Lys, Ser, Ala, Thr, Gly, or Val
  VARIANT (1081)..(1081): Lys, Ser, Ala, Thr, Gly, or Val
  VARIANT (1083)..(1083): Lys, Ser, Ala, Thr, Gly, or Val
  VARIANT (1085)..(1085): Lys, Ser, Ala, Thr, Gly, or Val
  VARIANT (1087)..(1087): Lys, Ser, Ala, Thr, Gly, or Val
  VARIANT (1089)..(1089): Lys, Ser, Ala, Thr, Gly, or Val
  VARIANT (1091)..(1091): Lys, Ser, Ala, Thr, Gly, or Val
  VARIANT (1093)..(1093): Lys, Ser, Ala, Thr, Gly, or Val
  VARIANT (1095)..(1095): Lys, Ser, Ala, Thr, Gly, or Val
  VARIANT (1097)..(1097): Lys, Ser, Ala, Thr, Gly, or Val
  VARIANT (1099)..(1099): Lys, Ser, Ala, Thr, Gly, or Val
  VARIANT (1101)..(1101): Lys, Ser, Ala, Thr, Gly, or Val
  VARIANT (1103)..(1103): Lys, Ser, Ala, Thr, Gly, or Val
  VARIANT (1105)..(1105): Lys, Ser, Ala, Thr, Gly, or Val
  VARIANT (1107)..(1107): Lys, Ser, Ala, Thr, Gly, or Val
  VARIANT (1109)..(1109): Lys, Ser, Ala, Thr, Gly, or Val
  VARIANT (1111)..(1111): Lys, Ser, Ala, Thr, Gly, or Val
  VARIANT (1113)..(1113): Lys, Ser, Ala, Thr, Gly, or Val
  VARIANT (1115)..(1115): Lys, Ser, Ala, Thr, Gly, or Val
  VARIANT (1117)..(1117): Lys, Ser, Ala, Thr, Gly, or Val
  VARIANT (1119)..(1119): Lys, Ser, Ala, Thr, Gly, or Val
  VARIANT (1121)..(1121): Lys, Ser, Ala, Thr, Gly, or Val
  VARIANT (1123)..(1123): Lys, Ser, Ala, Thr, Gly, or Val
  VARIANT (1125)..(1125): Lys, Ser, Ala, Thr, Gly, or Val
  VARIANT (1127)..(1127): Lys, Ser, Ala, Thr, Gly, or Val
  VARIANT (1129)..(1129): Lys, Ser, Ala, Thr, Gly, or Val
  VARIANT (1131)..(1131): Lys, Ser, Ala, Thr, Gly, or Val
  VARIANT (1133)..(1133): Lys, Ser, Ala, Thr, Gly, or Val
  VARIANT (1135)..(1135): Lys, Ser, Ala, Thr, Gly, or Val
  VARIANT (1137)..(1137): Lys, Ser, Ala, Thr, Gly, or Val
  VARIANT (1139)..(1139): Lys, Ser, Ala, Thr, Gly, or Val
  VARIANT (1141)..(1141): Lys, Ser, Ala, Thr, Gly, or Val
  VARIANT (1143)..(1143): Lys, Ser, Ala, Thr, Gly, or Val
  VARIANT (1145)..(1145): Lys, Ser, Ala, Thr, Gly, or Val
  VARIANT (1147)..(1147): Lys, Ser, Ala, Thr, Gly, or Val
  VARIANT (1149)..(1149): Lys, Ser, Ala, Thr, Gly, or Val
  VARIANT (1151)..(1151): Lys, Ser, Ala, Thr, Gly, or Val
  VARIANT (1153)..(1153): Lys, Ser, Ala, Thr, Gly, or Val
  VARIANT (1155)..(1155): Lys, Ser, Ala, Thr, Gly, or Val
  VARIANT (1157)..(1157): Lys, Ser, Ala, Thr, Gly, or Val
  VARIANT (1159)..(1159): Lys, Ser, Ala, Thr, Gly, or Val
  VARIANT (1161)..(1161): Lys, Ser, Ala, Thr, Gly, or Val
  VARIANT (1163)..(1163): Lys, Ser, Ala, Thr, Gly, or Val
  VARIANT (1165)..(1165): Lys, Ser, Ala, Thr, Gly, or Val
  VARIANT (1167)..(1167): Lys, Ser, Ala, Thr, Gly, or Val
  VARIANT (1169)..(1169): Lys, Ser, Ala, Thr, Gly, or Val
  VARIANT (1171)..(1171): Lys, Ser, Ala, Thr, Gly, or Val
  VARIANT (1173)..(1173): Lys, Ser, Ala, Thr, Gly, or Val
  VARIANT (1175)..(1175): Lys, Ser, Ala, Thr, Gly, or Val
  VARIANT (1177)..(1177): Lys, Ser, Ala, Thr, Gly, or Val
  VARIANT (1179)..(1179): Lys, Ser, Ala, Thr, Gly, or Val
  VARIANT (1181)..(1181): Lys, Ser, Ala, Thr, Gly, or Val
  VARIANT (1183)..(1183): Lys, Ser, Ala, Thr, Gly, or Val
  VARIANT (1185)..(1185): Lys, Ser, Ala, Thr, Gly, or Val
  VARIANT (1187)..(1187): Lys, Ser, Ala, Thr, Gly, or Val
  VARIANT (1189)..(1189): Lys, Ser, Ala, Thr, Gly, or Val
  VARIANT (1191)..(1191): Lys, Ser, Ala, Thr, Gly, or Val
  VARIANT (1193)..(1193): Lys, Ser, Ala, Thr, Gly, or Val
  VARIANT (1195)..(1195): Lys, Ser, Ala, Thr, Gly, or Val
  VARIANT (1197)..(1197): Lys, Ser, Ala, Thr, Gly, or Val
  VARIANT (1199)..(1199): Lys, Ser, Ala, Thr, Gly, or Val
  VARIANT (1201)..(1201): Lys, Ser, Ala, Thr, Gly, or Val
  VARIANT (1203)..(1203): Lys, Ser, Ala, Thr, Gly, or Val
  VARIANT (1205)..(1205): Lys, Ser, Ala, Thr, Gly, or Val
  VARIANT (1207)..(1207): Lys, Ser, Ala, Thr, Gly, or Val
  VARIANT (1209)..(1209): Lys, Ser, Ala, Thr, Gly, or Val
  VARIANT (1211)..(1211): Lys, Ser, Ala, Thr, Gly, or Val
  VARIANT (1213)..(1213): Lys, Ser, Ala, Thr, Gly, or Val
  VARIANT (1215)..(1215): Lys, Ser, Ala, Thr, Gly, or Val
  VARIANT (1217)..(1217): Lys, Ser, Ala, Thr, Gly, or Val
  VARIANT (1219)..(1219): Lys, Ser, Ala, Thr, Gly, or Val
  VARIANT (1221)..(1221): Lys, Ser, Ala, Thr, Gly, or Val
  VARIANT (1223)..(1223): Lys, Ser, Ala, Thr, Gly, or Val
  VARIANT (1225)..(1225): Lys, Ser, Ala, Thr, Gly, or Val
  VARIANT (1227)..(1227): Lys, Ser, Ala, Thr, Gly, or Val
  VARIANT (1229)..(1229): Lys, Ser, Ala, Thr, Gly, or Val
  VARIANT (1231)..(1231): Lys, Ser, Ala, Thr, Gly, or Val
  VARIANT (1233)..(1233): Lys, Ser, Ala, Thr, Gly, or Val
  VARIANT (1235)..(1235): Lys, Ser, Ala, Thr, Gly, or Val
  VARIANT (1237)..(1237): Lys, Ser, Ala, Thr, Gly, or Val
  VARIANT (1239)..(1239): Lys, Ser, Ala, Thr, Gly, or Val
  VARIANT (1241)..(1241): Lys, Ser, Ala, Thr, Gly, or Val
  VARIANT (1243)..(1243): Lys, Ser, Ala, Thr, Gly, or Val
  VARIANT (1245)..(1245): Lys, Ser, Ala, Thr, Gly, or Val
  VARIANT (1247)..(1247): Lys, Ser, Ala, Thr, Gly, or Val
  VARIANT (1249)..(1249): Lys, Ser, Ala, Thr, Gly, or Val
  VARIANT (1251)..(1251): Lys, Ser, Ala, Thr, Gly, or Val
  VARIANT (1253)..(1253): Lys, Ser, Ala, Thr, Gly, or Val
  VARIANT (1255)..(1255): Lys, Ser, Ala, Thr, Gly, or Val
  VARIANT (1257)..(1257): Lys, Ser, Ala, Thr, Gly, or Val
  VARIANT (1259)..(1259): Lys, Ser, Ala, Thr, Gly, or Val
  VARIANT (1261)..(1261): Lys, Ser, Ala, Thr, Gly, or Val
  VARIANT (1263)..(1263): Lys, Ser, Ala, Thr, Gly, or Val
  VARIANT (1265)..(1265): Lys, Ser, Ala, Thr, Gly, or Val
  VARIANT (1267)..(1267): Lys, Ser, Ala, Thr, Gly, or Val
  VARIANT (1269)..(1269): Lys, Ser, Ala, Thr, Gly, or Val
  VARIANT (1271)..(1271): Lys, Ser, Ala, Thr, Gly, or Val
  VARIANT (1273)..(1273): Lys, Ser, Ala, Thr, Gly, or Val
  VARIANT (1275)..(1275): Lys, Ser, Ala, Thr, Gly, or Val
  VARIANT (1277)..(1277): Lys, Ser, Ala, Thr, Gly, or Val
  VARIANT (1279)..(1279): Lys, Ser, Ala, Thr, Gly, or Val
  VARIANT (1281)..(1281): Lys, Ser, Ala, Thr, Gly, or Val
  VARIANT (1283)..(1283): Lys, Ser, Ala, Thr, Gly, or Val
  VARIANT (1285)..(1285): Lys, Ser, Ala, Thr, Gly, or Val
  VARIANT (1287)..(1287): Lys, Ser, Ala, Thr, Gly, or Val
  VARIANT (1289)..(1289): Lys, Ser, Ala, Thr, Gly, or Val
  VARIANT (1291)..(1291): Lys, Ser, Ala, Thr, Gly, or Val
  VARIANT (1293)..(1293): Lys, Ser, Ala, Thr, Gly, or Val
  VARIANT (1295)..(1295): Lys, Ser, Ala, Thr, Gly, or Val
  VARIANT (1297)..(1297): Lys, Ser, Ala, Thr, Gly, or Val
  VARIANT (1299)..(1299): Lys, Ser, Ala, Thr, Gly, or Val
  VARIANT (1301)..(1301): Lys, Ser, Ala, Thr, Gly, or Val
  VARIANT (1303)..(1303): Lys, Ser, Ala, Thr, Gly, or Val
  VARIANT (1305)..(1305): Lys, Ser, Ala, Thr, Gly, or Val
  VARIANT (1307)..(1307): Lys, Ser, Ala, Thr, Gly, or Val
  VARIANT (1309)..(1309): Lys, Ser, Ala, Thr, Gly, or Val
  VARIANT (1311)..(1311): Lys, Ser, Ala, Thr, Gly, or Val
  VARIANT (1313)..(1313): Lys, Ser, Ala, Thr, Gly, or Val
  VARIANT (1315)..(1315): Lys, Ser, Ala, Thr, Gly, or Val
  VARIANT (1317)..(1317): Lys, Ser, Ala, Thr, Gly, or Val
  VARIANT (1319)..(1319): Lys, Ser, Ala, Thr, Gly, or Val
  VARIANT (1321)..(1321): Lys, Ser, Ala, Thr, Gly, or Val
  VARIANT (1323)..(1323): Lys, Ser, Ala, Thr, Gly, or Val
  VARIANT (1325)..(1325): Lys, Ser, Ala, Thr, Gly, or Val
  VARIANT (1327)..(1327): Lys, Ser, Ala, Thr, Gly, or Val
  VARIANT (1329)..(1329): Lys, Ser, Ala, Thr, Gly, or Val
  VARIANT (1331)..(1331): Lys, Ser, Ala, Thr, Gly, or Val
  VARIANT (1333)..(1333): Lys, Ser, Ala, Thr, Gly, or Val
  VARIANT (1335)..(1335): Lys, Ser, Ala, Thr, Gly, or Val
  VARIANT (1337)..(1337): Lys, Ser, Ala, Thr, Gly, or Val
  VARIANT (1339)..(1339): Lys, Ser, Ala, Thr, Gly, or Val
  VARIANT (1341)..(1341): Lys, Ser, Ala, Thr, Gly, or Val
  VARIANT (1343)..(1343): Lys, Ser, Ala, Thr, Gly, or Val
  VARIANT (1345)..(1345): Lys, Ser, Ala, Thr, Gly, or Val
  VARIANT (1347)..(1347): Lys, Ser, Ala, Thr, Gly, or Val
  VARIANT (1349)..(1349): Lys, Ser, Ala, Thr, Gly, or Val
  VARIANT (1351)..(1351): Lys, Ser, Ala, Thr, Gly, or Val
  VARIANT (1353)..(1353): Lys, Ser, Ala, Thr, Gly, or Val
  VARIANT (1355)..(1355): Lys, Ser, Ala, Thr, Gly, or Val
  VARIANT (1357)..(1357): Lys, Ser, Ala, Thr, Gly, or Val
  VARIANT (1359)..(1359): Lys, Ser, Ala, Thr, Gly, or Val
  VARIANT (1361)..(1361): Lys, Ser, Ala, Thr, Gly, or Val
  VARIANT (1363)..(1363): Lys, Ser, Ala, Thr, Gly, or Val
  VARIANT (1365)..(1365): Lys, Ser, Ala, Thr, Gly, or Val
  VARIANT (1367)..(1367): Lys, Ser, Ala, Thr, Gly, or Val
  VARIANT (1369)..(1369): Lys, Ser, Ala, Thr, Gly, or Val
  VARIANT (1371)..(1371): Lys, Ser, Ala, Thr, Gly, or Val
  VARIANT (1373)..(1373): Lys, Ser, Ala, Thr, Gly, or Val
  VARIANT (1375)..(1375): Lys, Ser, Ala, Thr, Gly, or Val
  VARIANT (1377)..(1377): Lys, Ser, Ala, Thr, Gly, or Val
  VARIANT (1379)..(1379): Lys, Ser, Ala, Thr, Gly, or Val
  VARIANT (1381)..(1381): Lys, Ser, Ala, Thr, Gly, or Val
  VARIANT (1383)..(1383): Lys, Ser, Ala, Thr, Gly, or Val
  VARIANT (1385)..(1385): Lys, Ser, Ala, Thr, Gly, or Val
  VARIANT (1387)..(1387): Lys, Ser, Ala, Thr, Gly, or Val
  VARIANT (1389)..(1389): Lys, Ser, Ala, Thr, Gly, or Val
  VARIANT (1391)..(1391): Lys, Ser, Ala, Thr, Gly, or Val
  VARIANT (1393)..(1393): Lys, Ser, Ala, Thr, Gly, or Val
  VARIANT (1395)..(1395): Lys, Ser, Ala, Thr, Gly, or Val
  VARIANT (1397)..(1397): Lys, Ser, Ala, Thr, Gly, or Val
  VARIANT (1399)..(1399): Lys, Ser, Ala, Thr, Gly, or Val
  VARIANT (1401)..(1401): Lys, Ser, Ala, Thr, Gly, or Val
  VARIANT (1403)..(1403): Lys, Ser, Ala, Thr, Gly, or Val
  VARIANT (1405)..(1405): Lys, Ser, Ala, Thr, Gly, or Val
  VARIANT (1407)..(1407): Lys, Ser, Ala, Thr, Gly, or Val
  VARIANT (1409)..(1409): Lys, Ser, Ala, Thr, Gly, or Val
  VARIANT (1411)..(1411): Lys, Ser, Ala, Thr, Gly, or Val
  VARIANT (1413)..(1413): Lys, Ser, Ala, Thr, Gly, or Val
  VARIANT (1415)..(1415): Lys, Ser, Ala, Thr, Gly, or Val
  VARIANT (1417)..(1417): Lys, Ser, Ala, Thr, Gly, or Val
  VARIANT (1419)..(1419): Lys, Ser, Ala, Thr, Gly, or Val
  VARIANT (1421)..(1421): Lys, Ser, Ala, Thr, Gly, or Val
  VARIANT (1423)..(1423): Lys, Ser, Ala, Thr, Gly, or Val
  VARIANT (1425)..(1425): Lys, Ser, Ala, Thr, Gly, or Val
  VARIANT (1427)..(1427): Lys, Ser, Ala, Thr, Gly, or Val
  VARIANT (1429)..(1429): Lys, Ser, Ala, Thr, Gly, or Val
  VARIANT (1431)..(1431): Lys, Ser, Ala, Thr, Gly, or Val
  VARIANT (1433)..(1433): Lys, Ser, Ala, Thr, Gly, or Val
  VARIANT (1435)..(1435): Lys, Ser, Ala, Thr, Gly, or Val
  VARIANT (1437)..(1437): Lys, Ser, Ala, Thr, Gly, or Val
  VARIANT (1439)..(1439): Lys, Ser, Ala, Thr, Gly, or Val
  VARIANT (1441)..(1441): Lys, Ser, Ala, Thr, Gly, or Val
  VARIANT (1443)..(1443): Lys, Ser, Ala, Thr, Gly, or Val
  VARIANT (1445)..(1445): Lys, Ser, Ala, Thr, Gly, or Val
  VARIANT (1447)..(1447): Lys, Ser, Ala, Thr, Gly, or Val
  VARIANT (1449)..(1449): Lys, Ser, Ala, Thr, Gly, or Val
  VARIANT (1451)..(1451): Lys, Ser, Ala, Thr, Gly, or Val
  VARIANT (1453)..(1453): Lys, Ser, Ala, Thr, Gly, or Val
  VARIANT (1455)..(1455): Lys, Ser, Ala, Thr, Gly, or Val
  VARIANT (1457)..(1457): Lys, Ser, Ala, Thr, Gly, or Val
  VARIANT (1459)..(1459): Lys, Ser, Ala, Thr, Gly, or Val
  VARIANT (1461)..(1461): Lys, Ser, Ala, Thr, Gly, or Val
  VARIANT (1463)..(1463): Lys, Ser, Ala, Thr, Gly, or Val
  VARIANT (1465)..(1465): Lys, Ser, Ala, Thr, Gly, or Val
  VARIANT (1467)..(1467): Lys, Ser, Ala, Thr, Gly, or Val
  VARIANT (1469)..(1469): Lys, Ser, Ala, Thr, Gly, or Val
  VARIANT (1471)..(1471): Lys, Ser, Ala, Thr, Gly, or Val
  VARIANT (1473)..(1473): Lys, Ser, Ala, Thr, Gly, or Val
  VARIANT (1475)..(1475): Lys, Ser, Ala, Thr, Gly, or Val
  VARIANT (1477)..(1477): Lys, Ser, Ala, Thr, Gly, or Val
  VARIANT (1479)..(1479): Lys, Ser, Ala, Thr, Gly, or Val
  VARIANT (1481)..(1481): Lys, Ser, Ala, Thr, Gly, or Val
  VARIANT (1483)..(1483): Lys, Ser, Ala, Thr, Gly, or Val
  VARIANT (1485)..(1485): Lys, Ser, Ala, Thr, Gly, or Val
  VARIANT (1487)..(1487): Lys, Ser, Ala, Thr, Gly, or Val
  VARIANT (1489)..(1489): Lys, Ser, Ala, Thr, Gly, or Val
  VARIANT (1491)..(1491): Lys, Ser, Ala, Thr, Gly, or Val
  VARIANT (1493)..(1493): Lys, Ser, Ala, Thr, Gly, or Val
  VARIANT (1495)..(1495): Lys, Ser, Ala, Thr, Gly, or Val
  VARIANT (1497)..(1497): Lys, Ser, Ala, Thr, Gly, or Val
  VARIANT (1499)..(1499): Lys, Ser, Ala, Thr, Gly, or Val
  VARIANT (1501)..(1501): Lys, Ser, Ala, Thr, Gly, or Val
  VARIANT (1503)..(1503): Lys, Ser, Ala, Thr, Gly, or Val
  VARIANT (1505)..(1505): Lys, Ser, Ala, Thr, Gly, or Val
  VARIANT (1507)..(1507): Lys, Ser, Ala, Thr, Gly, or Val
  VARIANT (1509)..(1509): Lys, Ser, Ala, Thr, Gly, or Val
  VARIANT (1511)..(1511): Lys, Ser, Ala, Thr, Gly, or Val
  VARIANT (1513)..(1513): Lys, Ser, Ala, Thr, Gly, or Val
  VARIANT (1515)..(1515): Lys, Ser, Ala, Thr, Gly, or Val
  VARIANT (1517)..(1517): Lys, Ser, Ala, Thr, Gly, or Val
  VARIANT (1519)..(1519): Lys, Ser, Ala, Thr, Gly, or Val
  VARIANT (1521)..(1521): Lys, Ser, Ala, Thr, Gly, or Val
  VARIANT (1523)..(1523): Lys, Ser, Ala, Thr, Gly, or Val
  VARIANT (1525)..(1525): Lys, Ser, Ala, Thr, Gly, or Val
  VARIANT (1527)..(1527): Lys, Ser, Ala, Thr, Gly, or Val
  VARIANT (1529)..(1529): Lys, Ser, Ala, Thr, Gly, or Val
  VARIANT (1531)..(1531): Lys, Ser, Ala, Thr, Gly, or Val
  VARIANT (1533)..(1533): Lys, Ser, Ala, Thr, Gly, or Val
  VARIANT (1535)..(1535): Lys, Ser, Ala, Thr, Gly, or Val
  VARIANT (1537)..(1537): Lys, Ser, Ala, Thr, Gly, or Val
  VARIANT (1539)..(1539): Lys, Ser, Ala, Thr, Gly, or Val
  VARIANT (1541)..(1541): Lys, Ser, Ala, Thr, Gly, or Val
  VARIANT (1543)..(1543): Lys, Ser, Ala, Thr, Gly, or Val
  VARIANT (1545)..(1545): Lys, Ser, Ala, Thr, Gly, or Val
  VARIANT (1547)..(1547): Lys, Ser, Ala, Thr, Gly, or Val
  VARIANT (1549)..(1549): Lys, Ser, Ala, Thr, Gly, or Val
  VARIANT (1551)..(1551): Lys, Ser, Ala, Thr, Gly, or Val
  VARIANT (1553)..(1553): Lys, Ser, Ala, Thr, Gly, or Val
  VARIANT (1555)..(1555): Lys, Ser, Ala, Thr, Gly, or Val
  VARIANT (1557)..(1557): Lys, Ser, Ala, Thr, Gly, or Val
  VARIANT (1559)..(1559): Lys, Ser, Ala, Thr, Gly, or Val
  VARIANT (1561)..(1561): Lys, Ser, Ala, Thr, Gly, or Val
  VARIANT (1563)..(1563): Lys, Ser, Ala, Thr, Gly, or Val
  VARIANT (1565)..(1565): Lys, Ser, Ala, Thr, Gly, or Val
  VARIANT (1567)..(1567): Lys, Ser, Ala, Thr, Gly, or Val
  VARIANT (1569)..(1569): Lys, Ser, Ala, Thr, Gly, or Val
  VARIANT (1571)..(1571): Lys, Ser, Ala, Thr, Gly, or Val
  VARIANT (1573)..(1573): Lys, Ser, Ala, Thr, Gly, or Val
  VARIANT (1575)..(1575): Lys, Ser, Ala, Thr, Gly, or Val
  VARIANT (1577)..(1577): Lys, Ser, Ala, Thr, Gly, or Val
  VARIANT (1579)..(1579): Lys, Ser, Ala, Thr, Gly, or Val
  VARIANT (1581)..(1581): Lys, Ser, Ala, Thr, Gly, or Val
  VARIANT (1583)..(1583): Lys, Ser, Ala, Thr, Gly, or Val
  VARIANT (1585)..(1585): Lys, Ser, Ala, Thr, Gly, or Val
  VARIANT (1587)..(1587): Lys, Ser, Ala, Thr, Gly, or Val
  VARIANT (1589)..(1589): Lys, Ser, Ala, Thr, Gly, or Val
  VARIANT (1591)..(1591): Lys, Ser, Ala, Thr, Gly, or Val
  VARIANT (1593)..(1593): Lys, Ser, Ala, Thr, Gly, or Val
  VARIANT (1595)..(1595): Lys, Ser, Ala, Thr, Gly, or Val
  VARIANT (1597)..(1597): Lys, Ser, Ala, Thr, Gly, or Val
  VARIANT (1599)..(1599): Lys, Ser, Ala, Thr, Gly, or Val
  VARIANT (1601)..(1601): Lys, Ser, Ala, Thr, Gly, or Val
  VARIANT (1603)..(1603): Lys, Ser, Ala, Thr, Gly, or Val
  VARIANT (1605)..(1605): Lys, Ser, Ala, Thr, Gly, or Val
  VARIANT (1607)..(1607): Lys, Ser, Ala, Thr, Gly, or Val
  VARIANT (1609)..(1609): Lys, Ser, Ala, Thr, Gly, or Val
  VARIANT (1611)..(1611): Lys, Ser, Ala, Thr, Gly, or Val
  VARIANT (1613)..(1613): Lys, Ser, Ala, Thr, Gly, or Val
  VARIANT (1615)..(1615): Lys, Ser, Ala, Thr, Gly, or Val
  VARIANT (1617)..(1617): Lys, Ser, Ala, Thr, Gly, or Val
  VARIANT (1619)..(1619): Lys, Ser, Ala, Thr, Gly, or Val
  VARIANT (1621)..(1621): Lys, Ser, Ala, Thr, Gly, or Val
  VARIANT (1623)..(1623): Lys, Ser, Ala, Thr, Gly, or Val
  VARIANT (1625)..(1625): Lys, Ser, Ala, Thr, Gly, or Val
  VARIANT (1627)..(1627): Lys, Ser, Ala, Thr, Gly, or Val
  VARIANT (1629)..(1629): Lys, Ser, Ala, Thr, Gly, or Val
  VARIANT (1631)..(1631): Lys, Ser, Ala, Thr, Gly, or Val
  VARIANT (1633)..(1633): Lys, Ser, Ala, Thr, Gly, or Val
  VARIANT (1635)..(1635): Lys, Ser, Ala, Thr, Gly, or Val
  VARIANT (1637)..(1637): Lys, Ser, Ala, Thr, Gly, or Val
  VARIANT (1639)..(1639): Lys, Ser, Ala, Thr, Gly, or Val
  VARIANT (1641)..(1641): Lys, Ser, Ala, Thr, Gly, or Val
  VARIANT (1643)..(1643): Lys, Ser, Ala, Thr, Gly, or Val
  VARIANT (1645)..(1645): Lys, Ser, Ala, Thr, Gly, or Val
  VARIANT (1647)..(1647): Lys, Ser, Ala, Thr, Gly, or Val
  VARIANT (1649)..(1649): Lys, Ser, Ala, Thr, Gly, or Val
  VARIANT (1651)..(1651): Lys, Ser, Ala, Thr, Gly, or Val
  VARIANT (1653)..(1653): Lys, Ser, Ala, Thr, Gly, or Val
  VARIANT (1655)..(1655): Lys, Ser, Ala, Thr, Gly, or Val
  VARIANT (1657)..(1657): Lys, Ser, Ala, Thr, Gly, or Val
  VARIANT (1659)..(1659): Lys, Ser, Ala, Thr, Gly, or Val
  VARIANT (1661)..(1661): Lys, Ser, Ala, Thr, Gly, or Val
  VARIANT (1663)..(1663): Lys, Ser, Ala, Thr, Gly, or Val
  VARIANT (1665)..(1665): Lys, Ser, Ala, Thr, Gly, or Val
  VARIANT (1667)..(1667): Lys, Ser, Ala, Thr, Gly, or Val
  VARIANT (1669)..(1669): Lys, Ser, Ala, Thr, Gly, or Val
  VARIANT (1671)..(1671): Lys, Ser, Ala, Thr, Gly, or Val
  VARIANT (1673)..(1673): Lys, Ser, Ala, Thr, Gly, or Val
  VARIANT (1675)..(1675): Lys, Ser, Ala, Thr, Gly, or Val
  VARIANT (1677)..(1677): Lys, Ser, Ala, Thr, Gly, or Val
  VARIANT (1679)..(1679): Lys, Ser, Ala, Thr, Gly, or Val
  VARIANT (1681)..(1681): Lys, Ser, Ala, Thr, Gly, or Val
  VARIANT (1683)..(1683): Lys, Ser, Ala, Thr, Gly, or Val
  VARIANT (1685)..(1685): Lys, Ser, Ala, Thr, Gly, or Val
  VARIANT (1687)..(1687): Lys, Ser, Ala, Thr, Gly, or Val
  VARIANT (1689)..(1689): Lys, Ser, Ala, Thr, Gly, or Val
  VARIANT (1691)..(1691): Lys, Ser, Ala, Thr, Gly, or Val
  VARIANT (1693)..(1693): Lys, Ser, Ala, Thr, Gly, or Val
  VARIANT (1695)..(1695): Lys, Ser, Ala, Thr, Gly, or Val
  VARIANT (1697)..(1697): Lys, Ser, Ala, Thr, Gly, or Val
  VARIANT (1699)..(1699): Lys, Ser, Ala, Thr, Gly, or Val
  VARIANT (1701)..(1701): Lys, Ser, Ala, Thr, Gly, or Val
  VARIANT (1703)..(1703): Lys, Ser, Ala, Thr, Gly, or Val
  VARIANT (1705)..(1705): Lys, Ser, Ala, Thr, Gly, or Val
  VARIANT (1707)..(1707): Lys, Ser, Ala, Thr, Gly, or Val
  VARIANT (1709)..(1709): Lys, Ser, Ala, Thr, Gly, or Val
  VARIANT (1711)..(1711): Lys, Ser, Ala, Thr, Gly, or Val
  VARIANT (1713)..(1713): Lys, Ser, Ala, Thr, Gly, or Val
  VARIANT (1715)..(1715): Lys, Ser, Ala, Thr, Gly, or Val
  VARIANT (1717)..(1717): Lys, Ser, Ala, Thr, Gly, or Val
  VARIANT (1719)..(1719): Lys, Ser, Ala, Thr, Gly, or Val
  VARIANT (1721)..(1721): Lys, Ser, Ala, Thr, Gly, or Val
  VARIANT (1723)..(1723): Lys, Ser, Ala, Thr, Gly, or Val
  VARIANT (1725)..(1725): Lys, Ser, Ala, Thr, Gly, or Val
  VARIANT (1727)..(1727): Lys, Ser, Ala, Thr, Gly, or Val
  VARIANT (1729)..(1729): Lys, Ser, Ala, Thr, Gly, or Val
  VARIANT (1731)..(1731): Lys, Ser, Ala, Thr, Gly, or Val
  VARIANT (1733)..(1733): Lys, Ser, Ala, Thr, Gly, or Val
  VARIANT (1735)..(1735): Lys, Ser, Ala, Thr, Gly, or Val
  VARIANT (1737)..(1737): Lys, Ser, Ala, Thr, Gly, or Val
  VARIANT (1739)..(1739): Lys, Ser, Ala, Thr, Gly, or Val
  VARIANT (1741)..(1741): Lys, Ser, Ala, Thr, Gly, or Val
  VARIANT (1743)..(1743): Lys, Ser, Ala, Thr, Gly, or Val
  VARIANT (1745)..(1745): Lys, Ser, Ala, Thr, Gly, or Val
  VARIANT (1747)..(1747): Lys, Ser, Ala, Thr, Gly, or Val
  VARIANT (1749)..(1749): Lys, Ser, Ala, Thr, Gly, or Val
  VARIANT (1751)..(1751): Lys, Ser, Ala, Thr, Gly, or Val
  VARIANT (1753)..(1753): Lys, Ser, Ala, Thr, Gly, or Val
  VARIANT (1755)..(1755): Lys, Ser, Ala, Thr, Gly, or Val
  VARIANT (1757)..(1757): Lys, Ser, Ala, Thr, Gly, or Val
  VARIANT (1759)..(1759): Lys, Ser, Ala, Thr, Gly, or Val
  VARIANT (1761)..(1761): Lys, Ser, Ala, Thr, Gly, or Val
  VARIANT (1763)..(1763): Lys, Ser, Ala, Thr, Gly, or Val
  VARIANT (1765)..(1765): Lys, Ser, Ala, Thr, Gly, or Val
  VARIANT (1767)..(1767): Lys, Ser, Ala, Thr, Gly, or Val
  VARIANT (1769)..(1769): Lys, Ser, Ala, Thr, Gly, or Val
  VARIANT (1771)..(1771): Lys, Ser, Ala, Thr, Gly, or Val
  VARIANT (1773)..(1773): Lys, Ser, Ala, Thr, Gly, or Val
  VARIANT (1775)..(1775): Lys, Ser, Ala, Thr, Gly, or Val
  VARIANT (1777)..(1777): Lys, Ser, Ala, Thr, Gly, or Val
  VARIANT (1779)..(1779): Lys, Ser, Ala, Thr, Gly, or Val
  VARIANT (1781)..(1781): Lys, Ser, Ala, Thr, Gly, or Val
  VARIANT (1783)..(1783): Lys, Ser, Ala, Thr, Gly, or Val
  VARIANT (1785)..(1785): Lys, Ser, Ala, Thr, Gly, or Val
  VARIANT (1787)..(1787): Lys, Ser, Ala, Thr, Gly, or Val
  VARIANT (1789)..(1789): Lys, Ser, Ala, Thr, Gly, or Val
  VARIANT (1791)..(1791): Lys, Ser, Ala, Thr, Gly, or Val
  VARIANT (1793)..(1793): Lys, Ser, Ala, Thr, Gly, or Val
  VARIANT (1795)..(1795): Lys, Ser, Ala, Thr, Gly, or Val
  VARIANT (1797)..(1797): Lys, Ser, Ala, Thr, Gly, or Val
  VARIANT (1799)..(1799): Lys, Ser, Ala, Thr, Gly, or Val
  VARIANT (1801)..(1801): Lys, Ser, Ala, Thr, Gly, or Val
  VARIANT (1803)..(1803): Lys, Ser, Ala, Thr, Gly, or Val
  VARIANT (1805)..(1805): Lys, Ser, Ala, Thr, Gly, or Val
  VARIANT (1807)..(1807): Lys, Ser, Ala, Thr, Gly, or Val
  VARIANT (1809)..(1809): Lys, Ser, Ala, Thr, Gly, or Val
  VARIANT (1811)..(1811): Lys, Ser, Ala, Thr, Gly, or Val
  VARIANT (1813)..(1813): Lys, Ser, Ala, Thr, Gly, or Val
  VARIANT (1815)..(1815): Lys, Ser, Ala, Thr, Gly, or Val
  VARIANT (1817)..(1817): Lys, Ser, Ala, Thr, Gly, or Val
  VARIANT (1819)..(1819): Lys, Ser, Ala, Thr, Gly, or Val
  VARIANT (1821)..(1821): Lys, Ser, Ala, Thr, Gly, or Val
  VARIANT (1823)..(1823): Lys, Ser, Ala, Thr, Gly, or Val
  VARIANT (1825)..(1825): Lys, Ser, Ala, Thr, Gly, or Val
  VARIANT (1827)..(1827): Lys, Ser, Ala, Thr, Gly, or Val
  VARIANT (1829)..(1829): Lys, Ser, Ala, Thr, Gly, or Val
  VARIANT (1831)..(1831): Lys, Ser, Ala, Thr, Gly, or Val
  VARIANT (1833)..(1833): Lys, Ser, Ala, Thr, Gly, or Val
  VARIANT (1835)..(1835): Lys, Ser, Ala, Thr, Gly, or Val
  VARIANT (1837)..(1837): Lys, Ser, Ala, Thr, Gly, or Val
  VARIANT (1839)..(1839): Lys, Ser, Ala, Thr, Gly, or Val
  VARIANT (1841)..(1841): Lys, Ser, Ala, Thr, Gly, or Val
  VARIANT (1843)..(1843): Lys, Ser, Ala, Thr, Gly, or Val
  VARIANT (1845)..(1845): Lys, Ser, Ala, Thr, Gly, or Val
  VARIANT (1847)..(1847): Lys, Ser, Ala, Thr, Gly, or Val
  VARIANT (1849)..(1849): Lys, Ser, Ala, Thr, Gly, or Val
  VARIANT (1851)..(1851): Lys, Ser, Ala, Thr, Gly, or Val
  VARIANT (1853)..(1853): Lys, Ser, Ala, Thr, Gly, or Val
  VARIANT (1855)..(1855): Lys, Ser, Ala, Thr, Gly, or Val
  VARIANT (1857)..(1857): Lys, Ser, Ala, Thr, Gly, or Val
  VARIANT (1859)..(1859): Lys, Ser, Ala, Thr, Gly, or Val
  VARIANT (1861)..(1861): Lys, Ser, Ala, Thr, Gly, or Val
  VARIANT (1863)..(1863): Lys, Ser, Ala, Thr, Gly, or Val
  VARIANT (1865)..(1865): Lys, Ser, Ala, Thr, Gly, or Val
  VARIANT (1867)..(1867): Lys, Ser, Ala, Thr, Gly, or Val
  VARIANT (1869)..(1869): Lys, Ser, Ala, Thr, Gly, or Val
  VARIANT (1871)..(1871): Lys, Ser, Ala, Thr, Gly, or Val
  VARIANT (1873)..(1873): Lys, Ser, Ala, Thr, Gly, or Val
  VARIANT (1875)..(1875): Lys, Ser, Ala, Thr, Gly, or Val
  VARIANT (1877)..(1877): Lys, Ser, Ala, Thr, Gly, or Val
  VARIANT (1879)..(1879): Lys, Ser, Ala, Thr, Gly, or Val
  VARIANT (1881)..(1881): Lys, Ser, Ala, Thr, Gly, or Val
  VARIANT (1883)..(1883): Lys, Ser, Ala, Thr, Gly, or Val
  VARIANT (1885)..(1885): Lys, Ser, Ala, Thr, Gly, or Val
  VARIANT (1887)..(1887): Lys, Ser, Ala, Thr, Gly, or Val
  VARIANT (1889)..(1889): Lys, Ser, Ala, Thr, Gly, or Val
  VARIANT (1891)..(1891): Lys, Ser, Ala, Thr, Gly, or Val
  VARIANT (1893)..(1893): Lys, Ser, Ala, Thr, Gly, or Val
  VARIANT (1895)..(1895): Lys, Ser, Ala, Thr, Gly, or Val
  VARIANT (1897)..(1897): Lys, Ser, Ala, Thr, Gly, or Val
  VARIANT (1899)..(1899): Lys, Ser, Ala, Thr, Gly, or Val
  VARIANT (1901)..(1901): Lys, Ser, Ala, Thr, Gly, or Val
  VARIANT (1903)..(1903): Lys, Ser, Ala, Thr, Gly, or Val
  VARIANT (1905)..(1905): Lys, Ser, Ala, Thr, Gly, or Val
  VARIANT (1907)..(1907): Lys, Ser, Ala, Thr, Gly, or Val
  VARIANT (1909)..(1909): Lys, Ser, Ala, Thr, Gly, or Val
  VARIANT (1911)..(1911): Lys, Ser, Ala, Thr, Gly, or Val
  VARIANT (1913)..(1913): Lys, Ser, Ala, Thr, Gly, or Val
  VARIANT (1915)..(1915): Lys, Ser, Ala, Thr, Gly, or Val
  VARIANT (1917)..(1917): Lys, Ser, Ala, Thr, Gly, or Val
  VARIANT (1919)..(1919): Lys, Ser, Ala, Thr, Gly, or Val
  VARIANT (1921)..(1921): Lys, Ser, Ala, Thr, Gly, or Val
  VARIANT (1923)..(1923): Lys, Ser, Ala, Thr, Gly, or Val
  VARIANT (1925)..(1925): Lys, Ser, Ala, Thr, Gly, or Val
  VARIANT (1927)..(1927): Lys, Ser, Ala, Thr, Gly, or Val
  VARIANT (1929)..(1929): Lys, Ser, Ala, Thr, Gly, or Val
  VARIANT (1931)..(1931): Lys, Ser, Ala, Thr, Gly, or Val
  VARIANT (1933)..(1933): Lys, Ser, Ala, Thr, Gly, or Val
  VARIANT (1935)..(1935): Lys, Ser, Ala, Thr, Gly, or Val
  VARIANT (1937)..(1937): Lys, Ser, Ala, Thr, Gly, or Val
  VARIANT (1939)..(1939): Lys, Ser, Ala, Thr, Gly, or Val
  VARIANT (1941)..(1941): Lys, Ser, Ala, Thr, Gly, or Val
  VARIANT (1943)..(1943): Lys, Ser, Ala, Thr, Gly, or Val
  VARIANT (1945)..(1945): Lys, Ser, Ala, Thr, Gly, or Val
  VARIANT (1947)..(1947): Lys, Ser, Ala, Thr, Gly, or Val
  VARIANT (1949)..(1949): Lys, Ser, Ala, Thr, Gly, or Val
  VARIANT (1951)..(1951): Lys, Ser, Ala, Thr, Gly, or Val
  VARIANT (1953)..(1953): Lys, Ser, Ala, Thr, Gly, or Val
  VARIANT (1955)..(1955): Lys, Ser, Ala, Thr, Gly, or Val
  VARIANT (1957)..(1957): Lys, Ser, Ala, Thr, Gly, or Val
  VARIANT (1959)..(1959): Lys, Ser, Ala, Thr, Gly, or Val
  VARIANT (1961)..(1961): Lys, Ser, Ala, Thr, Gly, or Val
  VARIANT (1963)..(1963): Lys, Ser, Ala, Thr, Gly, or Val
  VARIANT (1965)..(1965): Lys, Ser, Ala, Thr, Gly, or Val
  VARIANT (1967)..(1967): Lys, Ser, Ala, Thr, Gly, or Val
  VARIANT (1969)..(1969): Lys, Ser, Ala, Thr, Gly, or Val
  VARIANT (1971)..(1971): Lys, Ser, Ala, Thr, Gly, or Val
  VARIANT (1973)..(1973): Lys, Ser, Ala, Thr, Gly, or Val
  VARIANT (1975)..(1975): Lys, Ser, Ala, Thr, Gly, or Val
  VARIANT (1977)..(1977): Lys, Ser, Ala, Thr, Gly, or Val
  VARIANT (1979)..(1979): Lys, Ser, Ala, Thr, Gly, or Val
  VARIANT (1981)..(1981): Lys, Ser, Ala, Thr, Gly, or Val
  VARIANT (1983)..(1983): Lys, Ser, Ala, Thr, Gly, or Val
  VARIANT (1985)..(1985): Lys, Ser, Ala, Thr, Gly, or Val
  VARIANT (1987)..(1987): Lys, Ser, Ala, Thr, Gly, or Val
  VARIANT (1989)..(1989): Lys, Ser, Ala, Thr, Gly, or Val
  VARIANT (1991)..(1991): Lys, Ser, Ala, Thr, Gly, or Val
  VARIANT (1993)..(1993): Lys, Ser, Ala, Thr, Gly, or Val
  VARIANT (1995)..(1995): Lys, Ser, Ala, Thr, Gly, or Val
  VARIANT (1997)..(1997): Lys, Ser, Ala, Thr, Gly, or Val
  VARIANT (1999)..(1999): Lys, Ser, Ala, Thr, Gly, or Val
  This sequence encompasses at least 2 to 1,000 (Xaa-Pro) repeating units, and subject to having the minumum number of repeating unitys, any one or more repeating units can either be present or absent
XPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXP

SEQ ID NO: 7 - protein, 102 aa, Artificial Sequence
  Description of Artificial Sequence: Synthetic amino acid motif
  VARIANT (1): Lys, Ser, Ala, Thr, Gly, or Val
  MOD_RES (3)..(102): This region encompasses at least 2 to 100 residues of Hydroxyproline, and subject to having the minumum number of residues, any one or more of amino acid residues 3 to 102 can either be present or absent
XPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 8 - protein, 101 aa, Artificial Sequence
  Description of Artificial Sequence: Synthetic amino acid motif
  VARIANT (1): Lys, Ser, Ala, Thr, Gly, or Val
  MOD_RES (2)..(101): This region encompasses at least 2 to 100 residues of Hydroxyproline, and subject to having the minumum number of residues, any one or more of amino acid residues 2 to 101 can either be present or absent
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 9 - protein, 200 aa, Artificial Sequence
  Description of Artificial Sequence: Synthetic peptide motif
  VARIANT (1): Lys, Ser, Ala, Thr, Gly, or Val
  MOD_RES (2): Hydroxyproline
  VARIANT (3): Lys, Ser, Ala, Thr, Gly, or Val
  MOD_RES (4): Hydroxyproline
  VARIANT (5): Lys, Ser, Ala, Thr, Gly, or Val
  MOD_RES (6): Hydroxyproline
  VARIANT (7): Lys, Ser, Ala, Thr, Gly, or Val
  MOD_RES (8): Hydroxyproline
  VARIANT (9): Lys, Ser, Ala, Thr, Gly, or Val
  MOD_RES (10): Hydroxyproline
  VARIANT (11): Lys, Ser, Ala, Thr, Gly, or Val
  MOD_RES (12): Hydroxyproline
  VARIANT (13): Lys, Ser, Ala, Thr, Gly, or Val
  MOD_RES (14): Hydroxyproline
  VARIANT (15): Lys, Ser, Ala, Thr, Gly, or Val
  MOD_RES (16): Hydroxyproline
  VARIANT (17): Lys, Ser, Ala, Thr, Gly, or Val
  MOD_RES (18): Hydroxyproline
  VARIANT (19): Lys, Ser, Ala, Thr, Gly, or Val
  MOD_RES (20): Hydroxyproline
  VARIANT (21): Lys, Ser, Ala, Thr, Gly, or Val
  MOD_RES (22): Hydroxyproline
  VARIANT (23): Lys, Ser, Ala, Thr, Gly, or Val
  MOD_RES (24): Hydroxyproline
  VARIANT (25): Lys, Ser, Ala, Thr, Gly, or Val
  MOD_RES (26): Hydroxyproline
  VARIANT (27): Lys, Ser, Ala, Thr, Gly, or Val
  MOD_RES (28): Hydroxyproline
  VARIANT (29): Lys, Ser, Ala, Thr, Gly, or Val
  MOD_RES (30): Hydroxyproline
  VARIANT (31): Lys, Ser, Ala, Thr, Gly, or Val
  MOD_RES (32): Hydroxyproline
  VARIANT (33): Lys, Ser, Ala, Thr, Gly, or Val
  MOD_RES (34): Hydroxyproline
  VARIANT (35): Lys, Ser, Ala, Thr, Gly, or Val
  MOD_RES (36): Hydroxyproline
  VARIANT (37): Lys, Ser, Ala, Thr, Gly, or Val
  MOD_RES (38): Hydroxyproline
  VARIANT (39): Lys, Ser, Ala, Thr, Gly, or Val
  MOD_RES (40): Hydroxyproline
  VARIANT (41): Lys, Ser, Ala, Thr, Gly, or Val
  MOD_RES (42): Hydroxyproline
  VARIANT (43): Lys, Ser, Ala, Thr, Gly, or Val
  MOD_RES (44): Hydroxyproline
  VARIANT (45): Lys, Ser, Ala, Thr, Gly, or Val
  MOD_RES (46): Hydroxyproline
  VARIANT (47): Lys, Ser, Ala, Thr, Gly, or Val
  MOD_RES (48): Hydroxyproline
  VARIANT (49): Lys, Ser, Ala, Thr, Gly, or Val
  MOD_RES (50): Hydroxyproline
  VARIANT (51): Lys, Ser, Ala, Thr, Gly, or Val
  MOD_RES (52): Hydroxyproline
  VARIANT (53): Lys, Ser, Ala, Thr, Gly, or Val
  MOD_RES (54): Hydroxyproline
  VARIANT (55): Lys, Ser, Ala, Thr, Gly, or Val
  MOD_RES (56): Hydroxyproline
  VARIANT (57): Lys, Ser, Ala, Thr, Gly, or Val
  MOD_RES (58): Hydroxyproline
  VARIANT (59): Lys, Ser, Ala, Thr, Gly, or Val
  MOD_RES (60): Hydroxyproline
  VARIANT (61): Lys, Ser, Ala, Thr, Gly, or Val
  MOD_RES (62): Hydroxyproline
  VARIANT (63): Lys, Ser, Ala, Thr, Gly, or Val
  MOD_RES (64): Hydroxyproline
  VARIANT (65): Lys, Ser, Ala, Thr, Gly, or Val
  MOD_RES (66): Hydroxyproline
  VARIANT (67): Lys, Ser, Ala, Thr, Gly, or Val
  MOD_RES (68): Hydroxyproline
  VARIANT (69): Lys, Ser, Ala, Thr, Gly, or Val
  MOD_RES (70): Hydroxyproline
  VARIANT (71): Lys, Ser, Ala, Thr, Gly, or Val
  MOD_RES (72): Hydroxyproline
  VARIANT (73): Lys, Ser, Ala, Thr, Gly, or Val
  MOD_RES (74): Hydroxyproline
  VARIANT (75): Lys, Ser, Ala, Thr, Gly, or Val
  MOD_RES (76): Hydroxyproline
  VARIANT (77): Lys, Ser, Ala, Thr, Gly, or Val
  MOD_RES (78): Hydroxyproline
  VARIANT (79): Lys, Ser, Ala, Thr, Gly, or Val
  MOD_RES (80): Hydroxyproline
  VARIANT (81): Lys, Ser, Ala, Thr, Gly, or Val
  MOD_RES (82): Hydroxyproline
  VARIANT (83): Lys, Ser, Ala, Thr, Gly, or Val
  MOD_RES (84): Hydroxyproline
  VARIANT (85): Lys, Ser, Ala, Thr, Gly, or Val
  MOD_RES (86): Hydroxyproline
  VARIANT (87): Lys, Ser, Ala, Thr, Gly, or Val
  MOD_RES (88): Hydroxyproline
  VARIANT (89): Lys, Ser, Ala, Thr, Gly, or Val
  MOD_RES (90): Hydroxyproline
  VARIANT (91): Lys, Ser, Ala, Thr, Gly, or Val
  MOD_RES (92): Hydroxyproline
  VARIANT (93): Lys, Ser, Ala, Thr, Gly, or Val
  MOD_RES (94): Hydroxyproline
  VARIANT (95): Lys, Ser, Ala, Thr, Gly, or Val
  MOD_RES (96): Hydroxyproline
  VARIANT (97): Lys, Ser, Ala, Thr, Gly, or Val
  MOD_RES (98): Hydroxyproline
  VARIANT (99): Lys, Ser, Ala, Thr, Gly, or Val
  MOD_RES (100): Hydroxyproline
  VARIANT (101): Lys, Ser, Ala, Thr, Gly, or Val
  MOD_RES (102): Hydroxyproline
  VARIANT (103): Lys, Ser, Ala, Thr, Gly, or Val
  MOD_RES (104): Hydroxyproline
  VARIANT (105): Lys, Ser, Ala, Thr, Gly, or Val
  MOD_RES (106): Hydroxyproline
  VARIANT (107): Lys, Ser, Ala, Thr, Gly, or Val
  MOD_RES (108): Hydroxyproline
  VARIANT (109): Lys, Ser, Ala, Thr, Gly, or Val
  MOD_RES (110): Hydroxyproline
  VARIANT (111): Lys, Ser, Ala, Thr, Gly, or Val
  MOD_RES (112): Hydroxyproline
  VARIANT (113): Lys, Ser, Ala, Thr, Gly, or Val
  MOD_RES (114): Hydroxyproline
  VARIANT (115): Lys, Ser, Ala, Thr, Gly, or Val
  MOD_RES (116): Hydroxyproline
  VARIANT (117): Lys, Ser, Ala, Thr, Gly, or Val
  MOD_RES (118): Hydroxyproline
  VARIANT (119): Lys, Ser, Ala, Thr, Gly, or Val
  MOD_RES (120): Hydroxyproline
  VARIANT (121): Lys, Ser, Ala, Thr, Gly, or Val
  MOD_RES (122): Hydroxyproline
  VARIANT (123): Lys, Ser, Ala, Thr, Gly, or Val
  MOD_RES (124): Hydroxyproline
  VARIANT (125): Lys, Ser, Ala, Thr, Gly, or Val
  MOD_RES (126): Hydroxyproline
  VARIANT (127): Lys, Ser, Ala, Thr, Gly, or Val
  MOD_RES (128): Hydroxyproline
  VARIANT (129): Lys, Ser, Ala, Thr, Gly, or Val
  MOD_RES (130): Hydroxyproline
  VARIANT (131): Lys, Ser, Ala, Thr, Gly, or Val
  MOD_RES (132): Hydroxyproline
  VARIANT (133): Lys, Ser, Ala, Thr, Gly, or Val
  MOD_RES (134): Hydroxyproline
  VARIANT (135): Lys, Ser, Ala, Thr, Gly, or Val
  MOD_RES (136): Hydroxyproline
  VARIANT (137): Lys, Ser, Ala, Thr, Gly, or Val
  MOD_RES (138): Hydroxyproline
  VARIANT (139): Lys, Ser, Ala, Thr, Gly, or Val
  MOD_RES (140): Hydroxyproline
  VARIANT (141): Lys, Ser, Ala, Thr, Gly, or Val
  MOD_RES (142): Hydroxyproline
  VARIANT (143): Lys, Ser, Ala, Thr, Gly, or Val
  MOD_RES (144): Hydroxyproline
  VARIANT (145): Lys, Ser, Ala, Thr, Gly, or Val
  MOD_RES (146): Hydroxyproline
  VARIANT (147): Lys, Ser, Ala, Thr, Gly, or Val
  MOD_RES (148): Hydroxyproline
  VARIANT (149): Lys, Ser, Ala, Thr, Gly, or Val
  MOD_RES (150): Hydroxyproline
  VARIANT (151): Lys, Ser, Ala, Thr, Gly, or Val
  MOD_RES (152): Hydroxyproline
  VARIANT (153): Lys, Ser, Ala, Thr, Gly, or Val
  MOD_RES (154): Hydroxyproline
  VARIANT (155): Lys, Ser, Ala, Thr, Gly, or Val
  MOD_RES (156): Hydroxyproline
  VARIANT (157): Lys, Ser, Ala, Thr, Gly, or Val
  MOD_RES (158): Hydroxyproline
  VARIANT (159): Lys, Ser, Ala, Thr, Gly, or Val
  MOD_RES (160): Hydroxyproline
  VARIANT (161): Lys, Ser, Ala, Thr, Gly, or Val
  MOD_RES (162): Hydroxyproline
  VARIANT (163): Lys, Ser, Ala, Thr, Gly, or Val
  MOD_RES (164): Hydroxyproline
  VARIANT (165): Lys, Ser, Ala, Thr, Gly, or Val
  MOD_RES (166): Hydroxyproline
  VARIANT (167): Lys, Ser, Ala, Thr, Gly, or Val
  MOD_RES (168): Hydroxyproline
  VARIANT (169): Lys, Ser, Ala, Thr, Gly, or Val
  MOD_RES (170): Hydroxyproline
  VARIANT (171): Lys, Ser, Ala, Thr, Gly, or Val
  MOD_RES (172): Hydroxyproline
  VARIANT (173): Lys, Ser, Ala, Thr, Gly, or Val
  MOD_RES (174): Hydroxyproline
  VARIANT (175): Lys, Ser, Ala, Thr, Gly, or Val
  MOD_RES (176): Hydroxyproline
  VARIANT (177): Lys, Ser, Ala, Thr, Gly, or Val
  MOD_RES (178): Hydroxyproline
  VARIANT (179): Lys, Ser, Ala, Thr, Gly, or Val
  MOD_RES (180): Hydroxyproline
  VARIANT (181): Lys, Ser, Ala, Thr, Gly, or Val
  MOD_RES (182): Hydroxyproline
  VARIANT (183): Lys, Ser, Ala, Thr, Gly, or Val
  MOD_RES (184): Hydroxyproline
  VARIANT (185): Lys, Ser, Ala, Thr, Gly, or Val
  MOD_RES (186): Hydroxyproline
  VARIANT (187): Lys, Ser, Ala, Thr, Gly, or Val
  MOD_RES (188): Hydroxyproline
  VARIANT (189): Lys, Ser, Ala, Thr, Gly, or Val
  MOD_RES (190): Hydroxyproline
  VARIANT (191): Lys, Ser, Ala, Thr, Gly, or Val
  MOD_RES (192): Hydroxyproline
  VARIANT (193): Lys, Ser, Ala, Thr, Gly, or Val
  MOD_RES (194): Hydroxyproline
  VARIANT (195): Lys, Ser, Ala, Thr, Gly, or Val
  MOD_RES (196): Hydroxyproline
  VARIANT (197): Lys, Ser, Ala, Thr, Gly, or Val
  MOD_RES (198): Hydroxyproline
  VARIANT (199): Lys, Ser, Ala, Thr, Gly, or Val
  MOD_RES (200): Hydroxyproline
  This sequence encompasses at least 1 to 100 (Xaa-Hyp) repeating units, and subject to having the minumum number of repeating unitys, any one or more repeating units can either be present or absent
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 10 - protein, 21 aa, Artificial Sequence
  Description of Artificial Sequence: Synthetic amino acid motif
  VARIANT (1): Lys, Ser, Ala, Thr, Gly, or Val
  MOD_RES (2)..(21): This region encompasses at least 2 to 20 residues of Hydroxyproline, and subject to having the minumum number of residues, any one or more of amino acid residues 2 to 21 can either be present or absent
XXXXXXXXXXXXXXXXXXXXX

SEQ ID NO: 11 - protein, 2000 aa, Artificial Sequence; identical to SEQ ID NO: 6
  Description of Artificial Sequence: Synthetic amino acid motif
  VARIANT (1)..(1): Lys, Ser, Ala, Thr, Gly, or Val
  VARIANT (3)..(3): Lys, Ser, Ala, Thr, Gly, or Val
  VARIANT (5)..(5): Lys, Ser, Ala, Thr, Gly, or Val
  VARIANT (7)..(7): Lys, Ser, Ala, Thr, Gly, or Val
  VARIANT (9)..(9): Lys, Ser, Ala, Thr, Gly, or Val
  VARIANT (11)..(11): Lys, Ser, Ala, Thr, Gly, or Val
  VARIANT (13)..(13): Lys, Ser, Ala, Thr, Gly, or Val
  VARIANT (15)..(15): Lys, Ser, Ala, Thr, Gly, or Val
  VARIANT (17)..(17): Lys, Ser, Ala, Thr, Gly, or Val
  VARIANT (19)..(19): Lys, Ser, Ala, Thr, Gly, or Val
  VARIANT (21)..(21): Lys, Ser, Ala, Thr, Gly, or Val
  VARIANT (23)..(23): Lys, Ser, Ala, Thr, Gly, or Val
  VARIANT (25)..(25): Lys, Ser, Ala, Thr, Gly, or Val
  VARIANT (27)..(27): Lys, Ser, Ala, Thr, Gly, or Val
  VARIANT (29)..(29): Lys, Ser, Ala, Thr, Gly, or Val
  VARIANT (31)..(31): Lys, Ser, Ala, Thr, Gly, or Val
  VARIANT (33)..(33): Lys, Ser, Ala, Thr, Gly, or Val
  VARIANT (35)..(35): Lys, Ser, Ala, Thr, Gly, or Val
  VARIANT (37)..(37): Lys, Ser, Ala, Thr, Gly, or Val
  VARIANT (39)..(39): Lys, Ser, Ala, Thr, Gly, or Val
  VARIANT (41)..(41): Lys, Ser, Ala, Thr, Gly, or Val
  VARIANT (43)..(43): Lys, Ser, Ala, Thr, Gly, or Val
  VARIANT (45)..(45): Lys, Ser, Ala, Thr, Gly, or Val
  VARIANT (47)..(47): Lys, Ser, Ala, Thr, Gly, or Val
  VARIANT (49)..(49): Lys, Ser, Ala, Thr, Gly, or Val
  VARIANT (51)..(51): Lys, Ser, Ala, Thr, Gly, or Val
  VARIANT (53)..(53): Lys, Ser, Ala, Thr, Gly, or Val
  VARIANT (55)..(55): Lys, Ser, Ala, Thr, Gly, or Val
  VARIANT (57)..(57): Lys, Ser, Ala, Thr, Gly, or Val
  VARIANT (59)..(59): Lys, Ser, Ala, Thr, Gly, or Val
  VARIANT (61)..(61): Lys, Ser, Ala, Thr, Gly, or Val
  VARIANT (63)..(63): Lys, Ser, Ala, Thr, Gly, or Val
  VARIANT (65)..(65): Lys, Ser, Ala, Thr, Gly, or Val
  VARIANT (67)..(67): Lys, Ser, Ala, Thr, Gly, or Val
  VARIANT (69)..(69): Lys, Ser, Ala, Thr, Gly, or Val
  VARIANT (71)..(71): Lys, Ser, Ala, Thr, Gly, or Val
  VARIANT (73)..(73): Lys, Ser, Ala, Thr, Gly, or Val
  VARIANT (75)..(75): Lys, Ser, Ala, Thr, Gly, or Val
  VARIANT (77)..(77): Lys, Ser, Ala, Thr, Gly, or Val
  VARIANT (79)..(79): Lys, Ser, Ala, Thr, Gly, or Val
  VARIANT (81)..(81): Lys, Ser, Ala, Thr, Gly, or Val
  VARIANT (83)..(83): Lys, Ser, Ala, Thr, Gly, or Val
  VARIANT (85)..(85): Lys, Ser, Ala, Thr, Gly, or Val
  VARIANT (87)..(87): Lys, Ser, Ala, Thr, Gly, or Val
  VARIANT (89)..(89): Lys, Ser, Ala, Thr, Gly, or Val
  VARIANT (91)..(91): Lys, Ser, Ala, Thr, Gly, or Val
  VARIANT (93)..(93): Lys, Ser, Ala, Thr, Gly, or Val
  VARIANT (95)..(95): Lys, Ser, Ala, Thr, Gly, or Val
  VARIANT (97)..(97): Lys, Ser, Ala, Thr, Gly, or Val
  VARIANT (99)..(99): Lys, Ser, Ala, Thr, Gly, or Val
  VARIANT (101)..(101): Lys, Ser, Ala, Thr, Gly, or Val
  VARIANT (103)..(103): Lys, Ser, Ala, Thr, Gly, or Val
  VARIANT (105)..(105): Lys, Ser, Ala, Thr, Gly, or Val
  VARIANT (107)..(107): Lys, Ser, Ala, Thr, Gly, or Val
  VARIANT (109)..(109): Lys, Ser, Ala, Thr, Gly, or Val
  VARIANT (111)..(111): Lys, Ser, Ala, Thr, Gly, or Val
  VARIANT (113)..(113): Lys, Ser, Ala, Thr, Gly, or Val
  VARIANT (115)..(115): Lys, Ser, Ala, Thr, Gly, or Val
  VARIANT (117)..(117): Lys, Ser, Ala, Thr, Gly, or Val
  VARIANT (119)..(119): Lys, Ser, Ala, Thr, Gly, or Val
  VARIANT (121)..(121): Lys, Ser, Ala, Thr, Gly, or Val
  VARIANT (123)..(123): Lys, Ser, Ala, Thr, Gly, or Val
  VARIANT (125)..(125): Lys, Ser, Ala, Thr, Gly, or Val
  VARIANT (127)..(127): Lys, Ser, Ala, Thr, Gly, or Val
  VARIANT (129)..(129): Lys, Ser, Ala, Thr, Gly, or Val
  VARIANT (131)..(131): Lys, Ser, Ala, Thr, Gly, or Val
  VARIANT (133)..(133): Lys, Ser, Ala, Thr, Gly, or Val
  VARIANT (135)..(135): Lys, Ser, Ala, Thr, Gly, or Val
  VARIANT (137)..(137): Lys, Ser, Ala, Thr, Gly, or Val
  VARIANT (139)..(139): Lys, Ser, Ala, Thr, Gly, or Val
  VARIANT (141)..(141): Lys, Ser, Ala, Thr, Gly, or Val
  VARIANT (143)..(143): Lys, Ser, Ala, Thr, Gly, or Val
  VARIANT (145)..(145): Lys, Ser, Ala, Thr, Gly, or Val
  VARIANT (147)..(147): Lys, Ser, Ala, Thr, Gly, or Val
  VARIANT (149)..(149): Lys, Ser, Ala, Thr, Gly, or Val
  VARIANT (151)..(151): Lys, Ser, Ala, Thr, Gly, or Val
  VARIANT (153)..(153): Lys, Ser, Ala, Thr, Gly, or Val
  VARIANT (155)..(155): Lys, Ser, Ala, Thr, Gly, or Val
  VARIANT (157)..(157): Lys, Ser, Ala, Thr, Gly, or Val
  VARIANT (159)..(159): Lys, Ser, Ala, Thr, Gly, or Val
  VARIANT (161)..(161): Lys, Ser, Ala, Thr, Gly, or Val
  VARIANT (163)..(163): Lys, Ser, Ala, Thr, Gly, or Val
  VARIANT (165)..(165): Lys, Ser, Ala, Thr, Gly, or Val
  VARIANT (167)..(167): Lys, Ser, Ala, Thr, Gly, or Val
  VARIANT (169)..(169): Lys, Ser, Ala, Thr, Gly, or Val
  VARIANT (171)..(171): Lys, Ser, Ala, Thr, Gly, or Val
  VARIANT (173)..(173): Lys, Ser, Ala, Thr, Gly, or Val
  VARIANT (175)..(175): Lys, Ser, Ala, Thr, Gly, or Val
  VARIANT (177)..(177): Lys, Ser, Ala, Thr, Gly, or Val
  VARIANT (179)..(179): Lys, Ser, Ala, Thr, Gly, or Val
  VARIANT (181)..(181): Lys, Ser, Ala, Thr, Gly, or Val
  VARIANT (183)..(183): Lys, Ser, Ala, Thr, Gly, or Val
  VARIANT (185)..(185): Lys, Ser, Ala, Thr, Gly, or Val
  VARIANT (187)..(187): Lys, Ser, Ala, Thr, Gly, or Val
  VARIANT (189)..(189): Lys, Ser, Ala, Thr, Gly, or Val
  VARIANT (191)..(191): Lys, Ser, Ala, Thr, Gly, or Val
  VARIANT (193)..(193): Lys, Ser, Ala, Thr, Gly, or Val
  VARIANT (195)..(195): Lys, Ser, Ala, Thr, Gly, or Val
  VARIANT (197)..(197): Lys, Ser, Ala, Thr, Gly, or Val
  VARIANT (199)..(199): Lys, Ser, Ala, Thr, Gly, or Val
  VARIANT (201)..(201): Lys, Ser, Ala, Thr, Gly, or Val
  VARIANT (203)..(203): Lys, Ser, Ala, Thr, Gly, or Val
  VARIANT (205)..(205): Lys, Ser, Ala, Thr, Gly, or Val
  VARIANT (207)..(207): Lys, Ser, Ala, Thr, Gly, or Val
  VARIANT (209)..(209): Lys, Ser, Ala, Thr, Gly, or Val
  VARIANT (211)..(211): Lys, Ser, Ala, Thr, Gly, or Val
  VARIANT (213)..(213): Lys, Ser, Ala, Thr, Gly, or Val
  VARIANT (215)..(215): Lys, Ser, Ala, Thr, Gly, or Val
  VARIANT (217)..(217): Lys, Ser, Ala, Thr, Gly, or Val
  VARIANT (219)..(219): Lys, Ser, Ala, Thr, Gly, or Val
  VARIANT (221)..(221): Lys, Ser, Ala, Thr, Gly, or Val
  VARIANT (223)..(223): Lys, Ser, Ala, Thr, Gly, or Val
  VARIANT (225)..(225): Lys, Ser, Ala, Thr, Gly, or Val
  VARIANT (227)..(227): Lys, Ser, Ala, Thr, Gly, or Val
  VARIANT (229)..(229): Lys, Ser, Ala, Thr, Gly, or Val
  VARIANT (231)..(231): Lys, Ser, Ala, Thr, Gly, or Val
  VARIANT (233)..(233): Lys, Ser, Ala, Thr, Gly, or Val
  VARIANT (235)..(235): Lys, Ser, Ala, Thr, Gly, or Val
  VARIANT (237)..(237): Lys, Ser, Ala, Thr, Gly, or Val
  VARIANT (239)..(239): Lys, Ser, Ala, Thr, Gly, or Val
  VARIANT (241)..(241): Lys, Ser, Ala, Thr, Gly, or Val
  VARIANT (243)..(243): Lys, Ser, Ala, Thr, Gly, or Val
  VARIANT (245)..(245): Lys, Ser, Ala, Thr, Gly, or Val
  VARIANT (247)..(247): Lys, Ser, Ala, Thr, Gly, or Val
  VARIANT (249)..(249): Lys, Ser, Ala, Thr, Gly, or Val
  VARIANT (251)..(251): Lys, Ser, Ala, Thr, Gly, or Val
  VARIANT (253)..(253): Lys, Ser, Ala, Thr, Gly, or Val
  VARIANT (255)..(255): Lys, Ser, Ala, Thr, Gly, or Val
  VARIANT (257)..(257): Lys, Ser, Ala, Thr, Gly, or Val
  VARIANT (259)..(259): Lys, Ser, Ala, Thr, Gly, or Val
  VARIANT (261)..(261): Lys, Ser, Ala, Thr, Gly, or Val
  VARIANT (263)..(263): Lys, Ser, Ala, Thr, Gly, or Val
  VARIANT (265)..(265): Lys, Ser, Ala, Thr, Gly, or Val
  VARIANT (267)..(267): Lys, Ser, Ala, Thr, Gly, or Val
  VARIANT (269)..(269): Lys, Ser, Ala, Thr, Gly, or Val
  VARIANT (271)..(271): Lys, Ser, Ala, Thr, Gly, or Val
  VARIANT (273)..(273): Lys, Ser, Ala, Thr, Gly, or Val
  VARIANT (275)..(275): Lys, Ser, Ala, Thr, Gly, or Val
  VARIANT (277)..(277): Lys, Ser, Ala, Thr, Gly, or Val
  VARIANT (279)..(279): Lys, Ser, Ala, Thr, Gly, or Val
  VARIANT (281)..(281): Lys, Ser, Ala, Thr, Gly, or Val
  VARIANT (283)..(283): Lys, Ser, Ala, Thr, Gly, or Val
  VARIANT (285)..(285): Lys, Ser, Ala, Thr, Gly, or Val
  VARIANT (287)..(287): Lys, Ser, Ala, Thr, Gly, or Val
  VARIANT (289)..(289): Lys, Ser, Ala, Thr, Gly, or Val
  VARIANT (291)..(291): Lys, Ser, Ala, Thr, Gly, or Val
  VARIANT (293)..(293): Lys, Ser, Ala, Thr, Gly, or Val
  VARIANT (295)..(295): Lys, Ser, Ala, Thr, Gly, or Val
  VARIANT (297)..(297): Lys, Ser, Ala, Thr, Gly, or Val
  VARIANT (299)..(299): Lys, Ser, Ala, Thr, Gly, or Val
  VARIANT (301)..(301): Lys, Ser, Ala, Thr, Gly, or Val
  VARIANT (303)..(303): Lys, Ser, Ala, Thr, Gly, or Val
  VARIANT (305)..(305): Lys, Ser, Ala, Thr, Gly, or Val
  VARIANT (307)..(307): Lys, Ser, Ala, Thr, Gly, or Val
  VARIANT (309)..(309): Lys, Ser, Ala, Thr, Gly, or Val
  VARIANT (311)..(311): Lys, Ser, Ala, Thr, Gly, or Val
  VARIANT (313)..(313): Lys, Ser, Ala, Thr, Gly, or Val
  VARIANT (315)..(315): Lys, Ser, Ala, Thr, Gly, or Val
  VARIANT (317)..(317): Lys, Ser, Ala, Thr, Gly, or Val
  VARIANT (319)..(319): Lys, Ser, Ala, Thr, Gly, or Val
  VARIANT (321)..(321): Lys, Ser, Ala, Thr, Gly, or Val
  VARIANT (323)..(323): Lys, Ser, Ala, Thr, Gly, or Val
  VARIANT (325)..(325): Lys, Ser, Ala, Thr, Gly, or Val
  VARIANT (327)..(327): Lys, Ser, Ala, Thr, Gly, or Val
  VARIANT (329)..(329): Lys, Ser, Ala, Thr, Gly, or Val
  VARIANT (331)..(331): Lys, Ser, Ala, Thr, Gly, or Val
  VARIANT (333)..(333): Lys, Ser, Ala, Thr, Gly, or Val
  VARIANT (335)..(335): Lys, Ser, Ala, Thr, Gly, or Val
  VARIANT (337)..(337): Lys, Ser, Ala, Thr, Gly, or Val
  VARIANT (339)..(339): Lys, Ser, Ala, Thr, Gly, or Val
  VARIANT (341)..(341): Lys, Ser, Ala, Thr, Gly, or Val
  VARIANT (343)..(343): Lys, Ser, Ala, Thr, Gly, or Val
  VARIANT (345)..(345): Lys, Ser, Ala, Thr, Gly, or Val
  VARIANT (347)..(347): Lys, Ser, Ala, Thr, Gly, or Val
  VARIANT (349)..(349): Lys, Ser, Ala, Thr, Gly, or Val
  VARIANT (351)..(351): Lys, Ser, Ala, Thr, Gly, or Val
  VARIANT (353)..(353): Lys, Ser, Ala, Thr, Gly, or Val
  VARIANT (355)..(355): Lys, Ser, Ala, Thr, Gly, or Val
  VARIANT (357)..(357): Lys, Ser, Ala, Thr, Gly, or Val
  VARIANT (359)..(359): Lys, Ser, Ala, Thr, Gly, or Val
  VARIANT (361)..(361): Lys, Ser, Ala, Thr, Gly, or Val
  VARIANT (363)..(363): Lys, Ser, Ala, Thr, Gly, or Val
  VARIANT (365)..(365): Lys, Ser, Ala, Thr, Gly, or Val
  VARIANT (367)..(367): Lys, Ser, Ala, Thr, Gly, or Val
  VARIANT (369)..(369): Lys, Ser, Ala, Thr, Gly, or Val
  VARIANT (371)..(371): Lys, Ser, Ala, Thr, Gly, or Val
  VARIANT (373)..(373): Lys, Ser, Ala, Thr, Gly, or Val
  VARIANT (375)..(375): Lys, Ser, Ala, Thr, Gly, or Val
  VARIANT (377)..(377): Lys, Ser, Ala, Thr, Gly, or Val
  VARIANT (379)..(379): Lys, Ser, Ala, Thr, Gly, or Val
  VARIANT (381)..(381): Lys, Ser, Ala, Thr, Gly, or Val
  VARIANT (383)..(383): Lys, Ser, Ala, Thr, Gly, or Val
  VARIANT (385)..(385): Lys, Ser, Ala, Thr, Gly, or Val
  VARIANT (387)..(387): Lys, Ser, Ala, Thr, Gly, or Val
  VARIANT (389)..(389): Lys, Ser, Ala, Thr, Gly, or Val
  VARIANT (391)..(391): Lys, Ser, Ala, Thr, Gly, or Val
  VARIANT (393)..(393): Lys, Ser, Ala, Thr, Gly, or Val
  VARIANT (395)..(395): Lys, Ser, Ala, Thr, Gly, or Val
  VARIANT (397)..(397): Lys, Ser, Ala, Thr, Gly, or Val
  VARIANT (399)..(399): Lys, Ser, Ala, Thr, Gly, or Val
  VARIANT (401)..(401): Lys, Ser, Ala, Thr, Gly, or Val
  VARIANT (403)..(403): Lys, Ser, Ala, Thr, Gly, or Val
  VARIANT (405)..(405): Lys, Ser, Ala, Thr, Gly, or Val
  VARIANT (407)..(407): Lys, Ser, Ala, Thr, Gly, or Val
  VARIANT (409)..(409): Lys, Ser, Ala, Thr, Gly, or Val
  VARIANT (411)..(411): Lys, Ser, Ala, Thr, Gly, or Val
  VARIANT (413)..(413): Lys, Ser, Ala, Thr, Gly, or Val
  VARIANT (415)..(415): Lys, Ser, Ala, Thr, Gly, or Val
  VARIANT (417)..(417): Lys, Ser, Ala, Thr, Gly, or Val
  VARIANT (419)..(419): Lys, Ser, Ala, Thr, Gly, or Val
  VARIANT (421)..(421): Lys, Ser, Ala, Thr, Gly, or Val
  VARIANT (423)..(423): Lys, Ser, Ala, Thr, Gly, or Val
  VARIANT (425)..(425): Lys, Ser, Ala, Thr, Gly, or Val
  VARIANT (427)..(427): Lys, Ser, Ala, Thr, Gly, or Val
  VARIANT (429)..(429): Lys, Ser, Ala, Thr, Gly, or Val
  VARIANT (431)..(431): Lys, Ser, Ala, Thr, Gly, or Val
  VARIANT (433)..(433): Lys, Ser, Ala, Thr, Gly, or Val
  VARIANT (435)..(435): Lys, Ser, Ala, Thr, Gly, or Val
  VARIANT (437)..(437): Lys, Ser, Ala, Thr, Gly, or Val
  VARIANT (439)..(439): Lys, Ser, Ala, Thr, Gly, or Val
  VARIANT (441)..(441): Lys, Ser, Ala, Thr, Gly, or Val
  VARIANT (443)..(443): Lys, Ser, Ala, Thr, Gly, or Val
  VARIANT (445)..(445): Lys, Ser, Ala, Thr, Gly, or Val
  VARIANT (447)..(447): Lys, Ser, Ala, Thr, Gly, or Val
  VARIANT (449)..(449): Lys, Ser, Ala, Thr, Gly, or Val
  VARIANT (451)..(451): Lys, Ser, Ala, Thr, Gly, or Val
  VARIANT (453)..(453): Lys, Ser, Ala, Thr, Gly, or Val
  VARIANT (455)..(455): Lys, Ser, Ala, Thr, Gly, or Val
  VARIANT (457)..(457): Lys, Ser, Ala, Thr, Gly, or Val
  VARIANT (459)..(459): Lys, Ser, Ala, Thr, Gly, or Val
  VARIANT (461)..(461): Lys, Ser, Ala, Thr, Gly, or Val
  VARIANT (463)..(463): Lys, Ser, Ala, Thr, Gly, or Val
  VARIANT (465)..(465): Lys, Ser, Ala, Thr, Gly, or Val
  VARIANT (467)..(467): Lys, Ser, Ala, Thr, Gly, or Val
  VARIANT (469)..(469): Lys, Ser, Ala, Thr, Gly, or Val
  VARIANT (471)..(471): Lys, Ser, Ala, Thr, Gly, or Val
  VARIANT (473)..(473): Lys, Ser, Ala, Thr, Gly, or Val
  VARIANT (475)..(475): Lys, Ser, Ala, Thr, Gly, or Val
  VARIANT (477)..(477): Lys, Ser, Ala, Thr, Gly, or Val
  VARIANT (479)..(479): Lys, Ser, Ala, Thr, Gly, or Val
  VARIANT (481)..(481): Lys, Ser, Ala, Thr, Gly, or Val
  VARIANT (483)..(483): Lys, Ser, Ala, Thr, Gly, or Val
  VARIANT (485)..(485): Lys, Ser, Ala, Thr, Gly, or Val
  VARIANT (487)..(487): Lys, Ser, Ala, Thr, Gly, or Val
  VARIANT (489)..(489): Lys, Ser, Ala, Thr, Gly, or Val
  VARIANT (491)..(491): Lys, Ser, Ala, Thr, Gly, or Val
  VARIANT (493)..(493): Lys, Ser, Ala, Thr, Gly, or Val
  VARIANT (495)..(495): Lys, Ser, Ala, Thr, Gly, or Val
  VARIANT (497)..(497): Lys, Ser, Ala, Thr, Gly, or Val
  VARIANT (499)..(499): Lys, Ser, Ala, Thr, Gly, or Val
  VARIANT (501)..(501): Lys, Ser, Ala, Thr, Gly, or Val
  VARIANT (503)..(503): Lys, Ser, Ala, Thr, Gly, or Val
  VARIANT (505)..(505): Lys, Ser, Ala, Thr, Gly, or Val
  VARIANT (507)..(507): Lys, Ser, Ala, Thr, Gly, or Val
  VARIANT (509)..(509): Lys, Ser, Ala, Thr, Gly, or Val
  VARIANT (511)..(511): Lys, Ser, Ala, Thr, Gly, or Val
  VARIANT (513)..(513): Lys, Ser, Ala, Thr, Gly, or Val
  VARIANT (515)..(515): Lys, Ser, Ala, Thr, Gly, or Val
  VARIANT (517)..(517): Lys, Ser, Ala, Thr, Gly, or Val
  VARIANT (519)..(519): Lys, Ser, Ala, Thr, Gly, or Val
  VARIANT (521)..(521): Lys, Ser, Ala, Thr, Gly, or Val
  VARIANT (523)..(523): Lys, Ser, Ala, Thr, Gly, or Val
  VARIANT (525)..(525): Lys, Ser, Ala, Thr, Gly, or Val
  VARIANT (527)..(527): Lys, Ser, Ala, Thr, Gly, or Val
  VARIANT (529)..(529): Lys, Ser, Ala, Thr, Gly, or Val
  VARIANT (531)..(531): Lys, Ser, Ala, Thr, Gly, or Val
  VARIANT (533)..(533): Lys, Ser, Ala, Thr, Gly, or Val
  VARIANT (535)..(535): Lys, Ser, Ala, Thr, Gly, or Val
  VARIANT (537)..(537): Lys, Ser, Ala, Thr, Gly, or Val
  VARIANT (539)..(539): Lys, Ser, Ala, Thr, Gly, or Val
  VARIANT (541)..(541): Lys, Ser, Ala, Thr, Gly, or Val
  VARIANT (543)..(543): Lys, Ser, Ala, Thr, Gly, or Val
  VARIANT (545)..(545): Lys, Ser, Ala, Thr, Gly, or Val
  VARIANT (547)..(547): Lys, Ser, Ala, Thr, Gly, or Val
  VARIANT (549)..(549): Lys, Ser, Ala, Thr, Gly, or Val
  VARIANT (551)..(551): Lys, Ser, Ala, Thr, Gly, or Val
  VARIANT (553)..(553): Lys, Ser, Ala, Thr, Gly, or Val
  VARIANT (555)..(555): Lys, Ser, Ala, Thr, Gly, or Val
  VARIANT (557)..(557): Lys, Ser, Ala, Thr, Gly, or Val
  VARIANT (559)..(559): Lys, Ser, Ala, Thr, Gly, or Val
  VARIANT (561)..(561): Lys, Ser, Ala, Thr, Gly, or Val
  VARIANT (563)..(563): Lys, Ser, Ala, Thr, Gly, or Val
  VARIANT (565)..(565): Lys, Ser, Ala, Thr, Gly, or Val
  VARIANT (567)..(567): Lys, Ser, Ala, Thr, Gly, or Val
  VARIANT (569)..(569): Lys, Ser, Ala, Thr, Gly, or Val
  VARIANT (571)..(571): Lys, Ser, Ala, Thr, Gly, or Val
  VARIANT (573)..(573): Lys, Ser, Ala, Thr, Gly, or Val
  VARIANT (575)..(575): Lys, Ser, Ala, Thr, Gly, or Val
  VARIANT (577)..(577): Lys, Ser, Ala, Thr, Gly, or Val
  VARIANT (579)..(579): Lys, Ser, Ala, Thr, Gly, or Val
  VARIANT (581)..(581): Lys, Ser, Ala, Thr, Gly, or Val
  VARIANT (583)..(583): Lys, Ser, Ala, Thr, Gly, or Val
  VARIANT (585)..(585): Lys, Ser, Ala, Thr, Gly, or Val
  VARIANT (587)..(587): Lys, Ser, Ala, Thr, Gly, or Val
  VARIANT (589)..(589): Lys, Ser, Ala, Thr, Gly, or Val
  VARIANT (591)..(591): Lys, Ser, Ala, Thr, Gly, or Val
  VARIANT (593)..(593): Lys, Ser, Ala, Thr, Gly, or Val
  VARIANT (595)..(595): Lys, Ser, Ala, Thr, Gly, or Val
  VARIANT (597)..(597): Lys, Ser, Ala, Thr, Gly, or Val
  VARIANT (599)..(599): Lys, Ser, Ala, Thr, Gly, or Val
  VARIANT (601)..(601): Lys, Ser, Ala, Thr, Gly, or Val
  VARIANT (603)..(603): Lys, Ser, Ala, Thr, Gly, or Val
  VARIANT (605)..(605): Lys, Ser, Ala, Thr, Gly, or Val
  VARIANT (607)..(607): Lys, Ser, Ala, Thr, Gly, or Val
  VARIANT (609)..(609): Lys, Ser, Ala, Thr, Gly, or Val
  VARIANT (611)..(611): Lys, Ser, Ala, Thr, Gly, or Val
  VARIANT (613)..(613): Lys, Ser, Ala, Thr, Gly, or Val
  VARIANT (615)..(615): Lys, Ser, Ala, Thr, Gly, or Val
  VARIANT (617)..(617): Lys, Ser, Ala, Thr, Gly, or Val
  VARIANT (619)..(619): Lys, Ser, Ala, Thr, Gly, or Val
  VARIANT (621)..(621): Lys, Ser, Ala, Thr, Gly, or Val
  VARIANT (623)..(623): Lys, Ser, Ala, Thr, Gly, or Val
  VARIANT (625)..(625): Lys, Ser, Ala, Thr, Gly, or Val
  VARIANT (627)..(627): Lys, Ser, Ala, Thr, Gly, or Val
  VARIANT (629)..(629): Lys, Ser, Ala, Thr, Gly, or Val
  VARIANT (631)..(631): Lys, Ser, Ala, Thr, Gly, or Val
  VARIANT (633)..(633): Lys, Ser, Ala, Thr, Gly, or Val
  VARIANT (635)..(635): Lys, Ser, Ala, Thr, Gly, or Val
  VARIANT (637)..(637): Lys, Ser, Ala, Thr, Gly, or Val
  VARIANT (639)..(639): Lys, Ser, Ala, Thr, Gly, or Val
  VARIANT (641)..(641): Lys, Ser, Ala, Thr, Gly, or Val
  VARIANT (643)..(643): Lys, Ser, Ala, Thr, Gly, or Val
  VARIANT (645)..(645): Lys, Ser, Ala, Thr, Gly, or Val
  VARIANT (647)..(647): Lys, Ser, Ala, Thr, Gly, or Val
  VARIANT (649)..(649): Lys, Ser, Ala, Thr, Gly, or Val
  VARIANT (651)..(651): Lys, Ser, Ala, Thr, Gly, or Val
  VARIANT (653)..(653): Lys, Ser, Ala, Thr, Gly, or Val
  VARIANT (655)..(655): Lys, Ser, Ala, Thr, Gly, or Val
  VARIANT (657)..(657): Lys, Ser, Ala, Thr, Gly, or Val
  VARIANT (659)..(659): Lys, Ser, Ala, Thr, Gly, or Val
  VARIANT (661)..(661): Lys, Ser, Ala, Thr, Gly, or Val
  VARIANT (663)..(663): Lys, Ser, Ala, Thr, Gly, or Val
  VARIANT (665)..(665): Lys, Ser, Ala, Thr, Gly, or Val
  VARIANT (667)..(667): Lys, Ser, Ala, Thr, Gly, or Val
  VARIANT (669)..(669): Lys, Ser, Ala, Thr, Gly, or Val
  VARIANT (671)..(671): Lys, Ser, Ala, Thr, Gly, or Val
  VARIANT (673)..(673): Lys, Ser, Ala, Thr, Gly, or Val
  VARIANT (675)..(675): Lys, Ser, Ala, Thr, Gly, or Val
  VARIANT (677)..(677): Lys, Ser, Ala, Thr, Gly, or Val
  VARIANT (679)..(679): Lys, Ser, Ala, Thr, Gly, or Val
  VARIANT (681)..(681): Lys, Ser, Ala, Thr, Gly, or Val
  VARIANT (683)..(683): Lys, Ser, Ala, Thr, Gly, or Val
  VARIANT (685)..(685): Lys, Ser, Ala, Thr, Gly, or Val
  VARIANT (687)..(687): Lys, Ser, Ala, Thr, Gly, or Val
  VARIANT (689)..(689): Lys, Ser, Ala, Thr, Gly, or Val
  VARIANT (691)..(691): Lys, Ser, Ala, Thr, Gly, or Val
  VARIANT (693)..(693): Lys, Ser, Ala, Thr, Gly, or Val
  VARIANT (695)..(695): Lys, Ser, Ala, Thr, Gly, or Val
  VARIANT (697)..(697): Lys, Ser, Ala, Thr, Gly, or Val
  VARIANT (699)..(699): Lys, Ser, Ala, Thr, Gly, or Val
  VARIANT (701)..(701): Lys, Ser, Ala, Thr, Gly, or Val
  VARIANT (703)..(703): Lys, Ser, Ala, Thr, Gly, or Val
  VARIANT (705)..(705): Lys, Ser, Ala, Thr, Gly, or Val
  VARIANT (707)..(707): Lys, Ser, Ala, Thr, Gly, or Val
  VARIANT (709)..(709): Lys, Ser, Ala, Thr, Gly, or Val
  VARIANT (711)..(711): Lys, Ser, Ala, Thr, Gly, or Val
  VARIANT (713)..(713): Lys, Ser, Ala, Thr, Gly, or Val
  VARIANT (715)..(715): Lys, Ser, Ala, Thr, Gly, or Val
  VARIANT (717)..(717): Lys, Ser, Ala, Thr, Gly, or Val
  VARIANT (719)..(719): Lys, Ser, Ala, Thr, Gly, or Val
  VARIANT (721)..(721): Lys, Ser, Ala, Thr, Gly, or Val
  VARIANT (723)..(723): Lys, Ser, Ala, Thr, Gly, or Val
  VARIANT (725)..(725): Lys, Ser, Ala, Thr, Gly, or Val
  VARIANT (727)..(727): Lys, Ser, Ala, Thr, Gly, or Val
  VARIANT (729)..(729): Lys, Ser, Ala, Thr, Gly, or Val
  VARIANT (731)..(731): Lys, Ser, Ala, Thr, Gly, or Val
  VARIANT (733)..(733): Lys, Ser, Ala, Thr, Gly, or Val
  VARIANT (735)..(735): Lys, Ser, Ala, Thr, Gly, or Val
  VARIANT (737)..(737): Lys, Ser, Ala, Thr, Gly, or Val
  VARIANT (739)..(739): Lys, Ser, Ala, Thr, Gly, or Val
  VARIANT (741)..(741): Lys, Ser, Ala, Thr, Gly, or Val
  VARIANT (743)..(743): Lys, Ser, Ala, Thr, Gly, or Val
  VARIANT (745)..(745): Lys, Ser, Ala, Thr, Gly, or Val
  VARIANT (747)..(747): Lys, Ser, Ala, Thr, Gly, or Val
  VARIANT (749)..(749): Lys, Ser, Ala, Thr, Gly, or Val
  VARIANT (751)..(751): Lys, Ser, Ala, Thr, Gly, or Val
  VARIANT (753)..(753): Lys, Ser, Ala, Thr, Gly, or Val
  VARIANT (755)..(755): Lys, Ser, Ala, Thr, Gly, or Val
  VARIANT (757)..(757): Lys, Ser, Ala, Thr, Gly, or Val
  VARIANT (759)..(759): Lys, Ser, Ala, Thr, Gly, or Val
  VARIANT (761)..(761): Lys, Ser, Ala, Thr, Gly, or Val
  VARIANT (763)..(763): Lys, Ser, Ala, Thr, Gly, or Val
  VARIANT (765)..(765): Lys, Ser, Ala, Thr, Gly, or Val
  VARIANT (767)..(767): Lys, Ser, Ala, Thr, Gly, or Val
  VARIANT (769)..(769): Lys, Ser, Ala, Thr, Gly, or Val
  VARIANT (771)..(771): Lys, Ser, Ala, Thr, Gly, or Val
  VARIANT (773)..(773): Lys, Ser, Ala, Thr, Gly, or Val
  VARIANT (775)..(775): Lys, Ser, Ala, Thr, Gly, or Val
  VARIANT (777)..(777): Lys, Ser, Ala, Thr, Gly, or Val
  VARIANT (779)..(779): Lys, Ser, Ala, Thr, Gly, or Val
  VARIANT (781)..(781): Lys, Ser, Ala, Thr, Gly, or Val
  VARIANT (783)..(783): Lys, Ser, Ala, Thr, Gly, or Val
  VARIANT (785)..(785): Lys, Ser, Ala, Thr, Gly, or Val
  VARIANT (787)..(787): Lys, Ser, Ala, Thr, Gly, or Val
  VARIANT (789)..(789): Lys, Ser, Ala, Thr, Gly, or Val
  VARIANT (791)..(791): Lys, Ser, Ala, Thr, Gly, or Val
  VARIANT (793)..(793): Lys, Ser, Ala, Thr, Gly, or Val
  VARIANT (795)..(795): Lys, Ser, Ala, Thr, Gly, or Val
  VARIANT (797)..(797): Lys, Ser, Ala, Thr, Gly, or Val
  VARIANT (799)..(799): Lys, Ser, Ala, Thr, Gly, or Val
  VARIANT (801)..(801): Lys, Ser, Ala, Thr, Gly, or Val
  VARIANT (803)..(803): Lys, Ser, Ala, Thr, Gly, or Val
  VARIANT (805)..(805): Lys, Ser, Ala, Thr, Gly, or Val
  VARIANT (807)..(807): Lys, Ser, Ala, Thr, Gly, or Val
  VARIANT (809)..(809): Lys, Ser, Ala, Thr, Gly, or Val
  VARIANT (811)..(811): Lys, Ser, Ala, Thr, Gly, or Val
  VARIANT (813)..(813): Lys, Ser, Ala, Thr, Gly, or Val
  VARIANT (815)..(815): Lys, Ser, Ala, Thr, Gly, or Val
  VARIANT (817)..(817): Lys, Ser, Ala, Thr, Gly, or Val
  VARIANT (819)..(819): Lys, Ser, Ala, Thr, Gly, or Val
  VARIANT (821)..(821): Lys, Ser, Ala, Thr, Gly, or Val
  VARIANT (823)..(823): Lys, Ser, Ala, Thr, Gly, or Val
  VARIANT (825)..(825): Lys, Ser, Ala, Thr, Gly, or Val
  VARIANT (827)..(827): Lys, Ser, Ala, Thr, Gly, or Val
  VARIANT (829)..(829): Lys, Ser, Ala, Thr, Gly, or Val
  VARIANT (831)..(831): Lys, Ser, Ala, Thr, Gly, or Val
  VARIANT (833)..(833): Lys, Ser, Ala, Thr, Gly, or Val
  VARIANT (835)..(835): Lys, Ser, Ala, Thr, Gly, or Val
  VARIANT (837)..(837): Lys, Ser, Ala, Thr, Gly, or Val
  VARIANT (839)..(839): Lys, Ser, Ala, Thr, Gly, or Val
  VARIANT (841)..(841): Lys, Ser, Ala, Thr, Gly, or Val
  VARIANT (843)..(843): Lys, Ser, Ala, Thr, Gly, or Val
  VARIANT (845)..(845): Lys, Ser, Ala, Thr, Gly, or Val
  VARIANT (847)..(847): Lys, Ser, Ala, Thr, Gly, or Val
  VARIANT (849)..(849): Lys, Ser, Ala, Thr, Gly, or Val
  VARIANT (851)..(851): Lys, Ser, Ala, Thr, Gly, or Val
  VARIANT (853)..(853): Lys, Ser, Ala, Thr, Gly, or Val
  VARIANT (855)..(855): Lys, Ser, Ala, Thr, Gly, or Val
  VARIANT (857)..(857): Lys, Ser, Ala, Thr, Gly, or Val
  VARIANT (859)..(859): Lys, Ser, Ala, Thr, Gly, or Val
  VARIANT (861)..(861): Lys, Ser, Ala, Thr, Gly, or Val
  VARIANT (863)..(863): Lys, Ser, Ala, Thr, Gly, or Val
  VARIANT (865)..(865): Lys, Ser, Ala, Thr, Gly, or Val
  VARIANT (867)..(867): Lys, Ser, Ala, Thr, Gly, or Val
  VARIANT (869)..(869): Lys, Ser, Ala, Thr, Gly, or Val
  VARIANT (871)..(871): Lys, Ser, Ala, Thr, Gly, or Val
  VARIANT (873)..(873): Lys, Ser, Ala, Thr, Gly, or Val
  VARIANT (875)..(875): Lys, Ser, Ala, Thr, Gly, or Val
  VARIANT (877)..(877): Lys, Ser, Ala, Thr, Gly, or Val
  VARIANT (879)..(879): Lys, Ser, Ala, Thr, Gly, or Val
  VARIANT (881)..(881): Lys, Ser, Ala, Thr, Gly, or Val
  VARIANT (883)..(883): Lys, Ser, Ala, Thr, Gly, or Val
  VARIANT (885)..(885): Lys, Ser, Ala, Thr, Gly, or Val
  VARIANT (887)..(887): Lys, Ser, Ala, Thr, Gly, or Val
  VARIANT (889)..(889): Lys, Ser, Ala, Thr, Gly, or Val
  VARIANT (891)..(891): Lys, Ser, Ala, Thr, Gly, or Val
  VARIANT (893)..(893): Lys, Ser, Ala, Thr, Gly, or Val
  VARIANT (895)..(895): Lys, Ser, Ala, Thr, Gly, or Val
  VARIANT (897)..(897): Lys, Ser, Ala, Thr, Gly, or Val
  VARIANT (899)..(899): Lys, Ser, Ala, Thr, Gly, or Val
  VARIANT (901)..(901): Lys, Ser, Ala, Thr, Gly, or Val
  VARIANT (903)..(903): Lys, Ser, Ala, Thr, Gly, or Val
  VARIANT (905)..(905): Lys, Ser, Ala, Thr, Gly, or Val
  VARIANT (907)..(907): Lys, Ser, Ala, Thr, Gly, or Val
  VARIANT (909)..(909): Lys, Ser, Ala, Thr, Gly, or Val
  VARIANT (911)..(911): Lys, Ser, Ala, Thr, Gly, or Val
  VARIANT (913)..(913): Lys, Ser, Ala, Thr, Gly, or Val
  VARIANT (915)..(915): Lys, Ser, Ala, Thr, Gly, or Val
  VARIANT (917)..(917): Lys, Ser, Ala, Thr, Gly, or Val
  VARIANT (919)..(919): Lys, Ser, Ala, Thr, Gly, or Val
  VARIANT (921)..(921): Lys, Ser, Ala, Thr, Gly, or Val
  VARIANT (923)..(923): Lys, Ser, Ala, Thr, Gly, or Val
  VARIANT (925)..(925): Lys, Ser, Ala, Thr, Gly, or Val
  VARIANT (927)..(927): Lys, Ser, Ala, Thr, Gly, or Val
  VARIANT (929)..(929): Lys, Ser, Ala, Thr, Gly, or Val
  VARIANT (931)..(931): Lys, Ser, Ala, Thr, Gly, or Val
  VARIANT (933)..(933): Lys, Ser, Ala, Thr, Gly, or Val
  VARIANT (935)..(935): Lys, Ser, Ala, Thr, Gly, or Val
  VARIANT (937)..(937): Lys, Ser, Ala, Thr, Gly, or Val
  VARIANT (939)..(939): Lys, Ser, Ala, Thr, Gly, or Val
  VARIANT (941)..(941): Lys, Ser, Ala, Thr, Gly, or Val
  VARIANT (943)..(943): Lys, Ser, Ala, Thr, Gly, or Val
  VARIANT (945)..(945): Lys, Ser, Ala, Thr, Gly, or Val
  VARIANT (947)..(947): Lys, Ser, Ala, Thr, Gly, or Val
  VARIANT (949)..(949): Lys, Ser, Ala, Thr, Gly, or Val
  VARIANT (951)..(951): Lys, Ser, Ala, Thr, Gly, or Val
  VARIANT (953)..(953): Lys, Ser, Ala, Thr, Gly, or Val
  VARIANT (955)..(955): Lys, Ser, Ala, Thr, Gly, or Val
  VARIANT (957)..(957): Lys, Ser, Ala, Thr, Gly, or Val
  VARIANT (959)..(959): Lys, Ser, Ala, Thr, Gly, or Val
  VARIANT (961)..(961): Lys, Ser, Ala, Thr, Gly, or Val
  VARIANT (963)..(963): Lys, Ser, Ala, Thr, Gly, or Val
  VARIANT (965)..(965): Lys, Ser, Ala, Thr, Gly, or Val
  VARIANT (967)..(967): Lys, Ser, Ala, Thr, Gly, or Val
  VARIANT (969)..(969): Lys, Ser, Ala, Thr, Gly, or Val
  VARIANT (971)..(971): Lys, Ser, Ala, Thr, Gly, or Val
  VARIANT (973)..(973): Lys, Ser, Ala, Thr, Gly, or Val
  VARIANT (975)..(975): Lys, Ser, Ala, Thr, Gly, or Val
  VARIANT (977)..(977): Lys, Ser, Ala, Thr, Gly, or Val
  VARIANT (979)..(979): Lys, Ser, Ala, Thr, Gly, or Val
  VARIANT (981)..(981): Lys, Ser, Ala, Thr, Gly, or Val
  VARIANT (983)..(983): Lys, Ser, Ala, Thr, Gly, or Val
  VARIANT (985)..(985): Lys, Ser, Ala, Thr, Gly, or Val
  VARIANT (987)..(987): Lys, Ser, Ala, Thr, Gly, or Val
  VARIANT (989)..(989): Lys, Ser, Ala, Thr, Gly, or Val
  VARIANT (991)..(991): Lys, Ser, Ala, Thr, Gly, or Val
  VARIANT (993)..(993): Lys, Ser, Ala, Thr, Gly, or Val
  VARIANT (995)..(995): Lys, Ser, Ala, Thr, Gly, or Val
  VARIANT (997)..(997): Lys, Ser, Ala, Thr, Gly, or Val
  VARIANT (999)..(999): Lys, Ser, Ala, Thr, Gly, or Val
  VARIANT (1001)..(1001): Lys, Ser, Ala, Thr, Gly, or Val
  VARIANT (1003)..(1003): Lys, Ser, Ala, Thr, Gly, or Val
  VARIANT (1005)..(1005): Lys, Ser, Ala, Thr, Gly, or Val
  VARIANT (1007)..(1007): Lys, Ser, Ala, Thr, Gly, or Val
  VARIANT (1009)..(1009): Lys, Ser, Ala, Thr, Gly, or Val
  VARIANT (1011)..(1011): Lys, Ser, Ala, Thr, Gly, or Val
  VARIANT (1013)..(1013): Lys, Ser, Ala, Thr, Gly, or Val
  VARIANT (1015)..(1015): Lys, Ser, Ala, Thr, Gly, or Val
  VARIANT (1017)..(1017): Lys, Ser, Ala, Thr, Gly, or Val
  VARIANT (1019)..(1019): Lys, Ser, Ala, Thr, Gly, or Val
  VARIANT (1021)..(1021): Lys, Ser, Ala, Thr, Gly, or Val
  VARIANT (1023)..(1023): Lys, Ser, Ala, Thr, Gly, or Val
  VARIANT (1025)..(1025): Lys, Ser, Ala, Thr, Gly, or Val
  VARIANT (1027)..(1027): Lys, Ser, Ala, Thr, Gly, or Val
  VARIANT (1029)..(1029): Lys, Ser, Ala, Thr, Gly, or Val
  VARIANT (1031)..(1031): Lys, Ser, Ala, Thr, Gly, or Val
  VARIANT (1033)..(1033): Lys, Ser, Ala, Thr, Gly, or Val
  VARIANT (1035)..(1035): Lys, Ser, Ala, Thr, Gly, or Val
  VARIANT (1037)..(1037): Lys, Ser, Ala, Thr, Gly, or Val
  VARIANT (1039)..(1039): Lys, Ser, Ala, Thr, Gly, or Val
  VARIANT (1041)..(1041): Lys, Ser, Ala, Thr, Gly, or Val
  VARIANT (1043)..(1043): Lys, Ser, Ala, Thr, Gly, or Val
  VARIANT (1045)..(1045): Lys, Ser, Ala, Thr, Gly, or Val
  VARIANT (1047)..(1047): Lys, Ser, Ala, Thr, Gly, or Val
  VARIANT (1049)..(1049): Lys, Ser, Ala, Thr, Gly, or Val
  VARIANT (1051)..(1051): Lys, Ser, Ala, Thr, Gly, or Val
  VARIANT (1053)..(1053): Lys, Ser, Ala, Thr, Gly, or Val
  VARIANT (1055)..(1055): Lys, Ser, Ala, Thr, Gly, or Val
  VARIANT (1057)..(1057): Lys, Ser, Ala, Thr, Gly, or Val
  VARIANT (1059)..(1059): Lys, Ser, Ala, Thr, Gly, or Val
  VARIANT (1061)..(1061): Lys, Ser, Ala, Thr, Gly, or Val
  VARIANT (1063)..(1063): Lys, Ser, Ala, Thr, Gly, or Val
  VARIANT (1065)..(1065): Lys, Ser, Ala, Thr, Gly, or Val
  VARIANT (1067)..(1067): Lys, Ser, Ala, Thr, Gly, or Val
  VARIANT (1069)..(1069): Lys, Ser, Ala, Thr, Gly, or Val
  VARIANT (1071)..(1071): Lys, Ser, Ala, Thr, Gly, or Val
  VARIANT (1073)..(1073): Lys, Ser, Ala, Thr, Gly, or Val
  VARIANT (1075)..(1075): Lys, Ser, Ala, Thr, Gly, or Val
  VARIANT (1077)..(1077): Lys, Ser, Ala, Thr, Gly, or Val
  VARIANT (1079)..(1079): Lys, Ser, Ala, Thr, Gly, or Val
  VARIANT (1081)..(1081): Lys, Ser, Ala, Thr, Gly, or Val
  VARIANT (1083)..(1083): Lys, Ser, Ala, Thr, Gly, or Val
  VARIANT (1085)..(1085): Lys, Ser, Ala, Thr, Gly, or Val
  VARIANT (1087)..(1087): Lys, Ser, Ala, Thr, Gly, or Val
  VARIANT (1089)..(1089): Lys, Ser, Ala, Thr, Gly, or Val
  VARIANT (1091)..(1091): Lys, Ser, Ala, Thr, Gly, or Val
  VARIANT (1093)..(1093): Lys, Ser, Ala, Thr, Gly, or Val
  VARIANT (1095)..(1095): Lys, Ser, Ala, Thr, Gly, or Val
  VARIANT (1097)..(1097): Lys, Ser, Ala, Thr, Gly, or Val
  VARIANT (1099)..(1099): Lys, Ser, Ala, Thr, Gly, or Val
  VARIANT (1101)..(1101): Lys, Ser, Ala, Thr, Gly, or Val
  VARIANT (1103)..(1103): Lys, Ser, Ala, Thr, Gly, or Val
  VARIANT (1105)..(1105): Lys, Ser, Ala, Thr, Gly, or Val
  VARIANT (1107)..(1107): Lys, Ser, Ala, Thr, Gly, or Val
  VARIANT (1109)..(1109): Lys, Ser, Ala, Thr, Gly, or Val
  VARIANT (1111)..(1111): Lys, Ser, Ala, Thr, Gly, or Val
  VARIANT (1113)..(1113): Lys, Ser, Ala, Thr, Gly, or Val
  VARIANT (1115)..(1115): Lys, Ser, Ala, Thr, Gly, or Val
  VARIANT (1117)..(1117): Lys, Ser, Ala, Thr, Gly, or Val
  VARIANT (1119)..(1119): Lys, Ser, Ala, Thr, Gly, or Val
  VARIANT (1121)..(1121): Lys, Ser, Ala, Thr, Gly, or Val
  VARIANT (1123)..(1123): Lys, Ser, Ala, Thr, Gly, or Val
  VARIANT (1125)..(1125): Lys, Ser, Ala, Thr, Gly, or Val
  VARIANT (1127)..(1127): Lys, Ser, Ala, Thr, Gly, or Val
  VARIANT (1129)..(1129): Lys, Ser, Ala, Thr, Gly, or Val
  VARIANT (1131)..(1131): Lys, Ser, Ala, Thr, Gly, or Val
  VARIANT (1133)..(1133): Lys, Ser, Ala, Thr, Gly, or Val
  VARIANT (1135)..(1135): Lys, Ser, Ala, Thr, Gly, or Val
  VARIANT (1137)..(1137): Lys, Ser, Ala, Thr, Gly, or Val
  VARIANT (1139)..(1139): Lys, Ser, Ala, Thr, Gly, or Val
  VARIANT (1141)..(1141): Lys, Ser, Ala, Thr, Gly, or Val
  VARIANT (1143)..(1143): Lys, Ser, Ala, Thr, Gly, or Val
  VARIANT (1145)..(1145): Lys, Ser, Ala, Thr, Gly, or Val
  VARIANT (1147)..(1147): Lys, Ser, Ala, Thr, Gly, or Val
  VARIANT (1149)..(1149): Lys, Ser, Ala, Thr, Gly, or Val
  VARIANT (1151)..(1151): Lys, Ser, Ala, Thr, Gly, or Val
  VARIANT (1153)..(1153): Lys, Ser, Ala, Thr, Gly, or Val
  VARIANT (1155)..(1155): Lys, Ser, Ala, Thr, Gly, or Val
  VARIANT (1157)..(1157): Lys, Ser, Ala, Thr, Gly, or Val
  VARIANT (1159)..(1159): Lys, Ser, Ala, Thr, Gly, or Val
  VARIANT (1161)..(1161): Lys, Ser, Ala, Thr, Gly, or Val
  VARIANT (1163)..(1163): Lys, Ser, Ala, Thr, Gly, or Val
  VARIANT (1165)..(1165): Lys, Ser, Ala, Thr, Gly, or Val
  VARIANT (1167)..(1167): Lys, Ser, Ala, Thr, Gly, or Val
  VARIANT (1169)..(1169): Lys, Ser, Ala, Thr, Gly, or Val
  VARIANT (1171)..(1171): Lys, Ser, Ala, Thr, Gly, or Val
  VARIANT (1173)..(1173): Lys, Ser, Ala, Thr, Gly, or Val
  VARIANT (1175)..(1175): Lys, Ser, Ala, Thr, Gly, or Val
  VARIANT (1177)..(1177): Lys, Ser, Ala, Thr, Gly, or Val
  VARIANT (1179)..(1179): Lys, Ser, Ala, Thr, Gly, or Val
  VARIANT (1181)..(1181): Lys, Ser, Ala, Thr, Gly, or Val
  VARIANT (1183)..(1183): Lys, Ser, Ala, Thr, Gly, or Val
  VARIANT (1185)..(1185): Lys, Ser, Ala, Thr, Gly, or Val
  VARIANT (1187)..(1187): Lys, Ser, Ala, Thr, Gly, or Val
  VARIANT (1189)..(1189): Lys, Ser, Ala, Thr, Gly, or Val
  VARIANT (1191)..(1191): Lys, Ser, Ala, Thr, Gly, or Val
  VARIANT (1193)..(1193): Lys, Ser, Ala, Thr, Gly, or Val
  VARIANT (1195)..(1195): Lys, Ser, Ala, Thr, Gly, or Val
  VARIANT (1197)..(1197): Lys, Ser, Ala, Thr, Gly, or Val
  VARIANT (1199)..(1199): Lys, Ser, Ala, Thr, Gly, or Val
  VARIANT (1201)..(1201): Lys, Ser, Ala, Thr, Gly, or Val
  VARIANT (1203)..(1203): Lys, Ser, Ala, Thr, Gly, or Val
  VARIANT (1205)..(1205): Lys, Ser, Ala, Thr, Gly, or Val
  VARIANT (1207)..(1207): Lys, Ser, Ala, Thr, Gly, or Val
  VARIANT (1209)..(1209): Lys, Ser, Ala, Thr, Gly, or Val
  VARIANT (1211)..(1211): Lys, Ser, Ala, Thr, Gly, or Val
  VARIANT (1213)..(1213): Lys, Ser, Ala, Thr, Gly, or Val
  VARIANT (1215)..(1215): Lys, Ser, Ala, Thr, Gly, or Val
  VARIANT (1217)..(1217): Lys, Ser, Ala, Thr, Gly, or Val
  VARIANT (1219)..(1219): Lys, Ser, Ala, Thr, Gly, or Val
  VARIANT (1221)..(1221): Lys, Ser, Ala, Thr, Gly, or Val
  VARIANT (1223)..(1223): Lys, Ser, Ala, Thr, Gly, or Val
  VARIANT (1225)..(1225): Lys, Ser, Ala, Thr, Gly, or Val
  VARIANT (1227)..(1227): Lys, Ser, Ala, Thr, Gly, or Val
  VARIANT (1229)..(1229): Lys, Ser, Ala, Thr, Gly, or Val
  VARIANT (1231)..(1231): Lys, Ser, Ala, Thr, Gly, or Val
  VARIANT (1233)..(1233): Lys, Ser, Ala, Thr, Gly, or Val
  VARIANT (1235)..(1235): Lys, Ser, Ala, Thr, Gly, or Val
  VARIANT (1237)..(1237): Lys, Ser, Ala, Thr, Gly, or Val
  VARIANT (1239)..(1239): Lys, Ser, Ala, Thr, Gly, or Val
  VARIANT (1241)..(1241): Lys, Ser, Ala, Thr, Gly, or Val
  VARIANT (1243)..(1243): Lys, Ser, Ala, Thr, Gly, or Val
  VARIANT (1245)..(1245): Lys, Ser, Ala, Thr, Gly, or Val
  VARIANT (1247)..(1247): Lys, Ser, Ala, Thr, Gly, or Val
  VARIANT (1249)..(1249): Lys, Ser, Ala, Thr, Gly, or Val
  VARIANT (1251)..(1251): Lys, Ser, Ala, Thr, Gly, or Val
  VARIANT (1253)..(1253): Lys, Ser, Ala, Thr, Gly, or Val
  VARIANT (1255)..(1255): Lys, Ser, Ala, Thr, Gly, or Val
  VARIANT (1257)..(1257): Lys, Ser, Ala, Thr, Gly, or Val
  VARIANT (1259)..(1259): Lys, Ser, Ala, Thr, Gly, or Val
  VARIANT (1261)..(1261): Lys, Ser, Ala, Thr, Gly, or Val
  VARIANT (1263)..(1263): Lys, Ser, Ala, Thr, Gly, or Val
  VARIANT (1265)..(1265): Lys, Ser, Ala, Thr, Gly, or Val
  VARIANT (1267)..(1267): Lys, Ser, Ala, Thr, Gly, or Val
  VARIANT (1269)..(1269): Lys, Ser, Ala, Thr, Gly, or Val
  VARIANT (1271)..(1271): Lys, Ser, Ala, Thr, Gly, or Val
  VARIANT (1273)..(1273): Lys, Ser, Ala, Thr, Gly, or Val
  VARIANT (1275)..(1275): Lys, Ser, Ala, Thr, Gly, or Val
  VARIANT (1277)..(1277): Lys, Ser, Ala, Thr, Gly, or Val
  VARIANT (1279)..(1279): Lys, Ser, Ala, Thr, Gly, or Val
  VARIANT (1281)..(1281): Lys, Ser, Ala, Thr, Gly, or Val
  VARIANT (1283)..(1283): Lys, Ser, Ala, Thr, Gly, or Val
  VARIANT (1285)..(1285): Lys, Ser, Ala, Thr, Gly, or Val
  VARIANT (1287)..(1287): Lys, Ser, Ala, Thr, Gly, or Val
  VARIANT (1289)..(1289): Lys, Ser, Ala, Thr, Gly, or Val
  VARIANT (1291)..(1291): Lys, Ser, Ala, Thr, Gly, or Val
  VARIANT (1293)..(1293): Lys, Ser, Ala, Thr, Gly, or Val
  VARIANT (1295)..(1295): Lys, Ser, Ala, Thr, Gly, or Val
  VARIANT (1297)..(1297): Lys, Ser, Ala, Thr, Gly, or Val
  VARIANT (1299)..(1299): Lys, Ser, Ala, Thr, Gly, or Val
  VARIANT (1301)..(1301): Lys, Ser, Ala, Thr, Gly, or Val
  VARIANT (1303)..(1303): Lys, Ser, Ala, Thr, Gly, or Val
  VARIANT (1305)..(1305): Lys, Ser, Ala, Thr, Gly, or Val
  VARIANT (1307)..(1307): Lys, Ser, Ala, Thr, Gly, or Val
  VARIANT (1309)..(1309): Lys, Ser, Ala, Thr, Gly, or Val
  VARIANT (1311)..(1311): Lys, Ser, Ala, Thr, Gly, or Val
  VARIANT (1313)..(1313): Lys, Ser, Ala, Thr, Gly, or Val
  VARIANT (1315)..(1315): Lys, Ser, Ala, Thr, Gly, or Val
  VARIANT (1317)..(1317): Lys, Ser, Ala, Thr, Gly, or Val
  VARIANT (1319)..(1319): Lys, Ser, Ala, Thr, Gly, or Val
  VARIANT (1321)..(1321): Lys, Ser, Ala, Thr, Gly, or Val
  VARIANT (1323)..(1323): Lys, Ser, Ala, Thr, Gly, or Val
  VARIANT (1325)..(1325): Lys, Ser, Ala, Thr, Gly, or Val
  VARIANT (1327)..(1327): Lys, Ser, Ala, Thr, Gly, or Val
  VARIANT (1329)..(1329): Lys, Ser, Ala, Thr, Gly, or Val
  VARIANT (1331)..(1331): Lys, Ser, Ala, Thr, Gly, or Val
  VARIANT (1333)..(1333): Lys, Ser, Ala, Thr, Gly, or Val
  VARIANT (1335)..(1335): Lys, Ser, Ala, Thr, Gly, or Val
  VARIANT (1337)..(1337): Lys, Ser, Ala, Thr, Gly, or Val
  VARIANT (1339)..(1339): Lys, Ser, Ala, Thr, Gly, or Val
  VARIANT (1341)..(1341): Lys, Ser, Ala, Thr, Gly, or Val
  VARIANT (1343)..(1343): Lys, Ser, Ala, Thr, Gly, or Val
  VARIANT (1345)..(1345): Lys, Ser, Ala, Thr, Gly, or Val
  VARIANT (1347)..(1347): Lys, Ser, Ala, Thr, Gly, or Val
  VARIANT (1349)..(1349): Lys, Ser, Ala, Thr, Gly, or Val
  VARIANT (1351)..(1351): Lys, Ser, Ala, Thr, Gly, or Val
  VARIANT (1353)..(1353): Lys, Ser, Ala, Thr, Gly, or Val
  VARIANT (1355)..(1355): Lys, Ser, Ala, Thr, Gly, or Val
  VARIANT (1357)..(1357): Lys, Ser, Ala, Thr, Gly, or Val
  VARIANT (1359)..(1359): Lys, Ser, Ala, Thr, Gly, or Val
  VARIANT (1361)..(1361): Lys, Ser, Ala, Thr, Gly, or Val
  VARIANT (1363)..(1363): Lys, Ser, Ala, Thr, Gly, or Val
  VARIANT (1365)..(1365): Lys, Ser, Ala, Thr, Gly, or Val
  VARIANT (1367)..(1367): Lys, Ser, Ala, Thr, Gly, or Val
  VARIANT (1369)..(1369): Lys, Ser, Ala, Thr, Gly, or Val
  VARIANT (1371)..(1371): Lys, Ser, Ala, Thr, Gly, or Val
  VARIANT (1373)..(1373): Lys, Ser, Ala, Thr, Gly, or Val
  VARIANT (1375)..(1375): Lys, Ser, Ala, Thr, Gly, or Val
  VARIANT (1377)..(1377): Lys, Ser, Ala, Thr, Gly, or Val
  VARIANT (1379)..(1379): Lys, Ser, Ala, Thr, Gly, or Val
  VARIANT (1381)..(1381): Lys, Ser, Ala, Thr, Gly, or Val
  VARIANT (1383)..(1383): Lys, Ser, Ala, Thr, Gly, or Val
  VARIANT (1385)..(1385): Lys, Ser, Ala, Thr, Gly, or Val
  VARIANT (1387)..(1387): Lys, Ser, Ala, Thr, Gly, or Val
  VARIANT (1389)..(1389): Lys, Ser, Ala, Thr, Gly, or Val
  VARIANT (1391)..(1391): Lys, Ser, Ala, Thr, Gly, or Val
  VARIANT (1393)..(1393): Lys, Ser, Ala, Thr, Gly, or Val
  VARIANT (1395)..(1395): Lys, Ser, Ala, Thr, Gly, or Val
  VARIANT (1397)..(1397): Lys, Ser, Ala, Thr, Gly, or Val
  VARIANT (1399)..(1399): Lys, Ser, Ala, Thr, Gly, or Val
  VARIANT (1401)..(1401): Lys, Ser, Ala, Thr, Gly, or Val
  VARIANT (1403)..(1403): Lys, Ser, Ala, Thr, Gly, or Val
  VARIANT (1405)..(1405): Lys, Ser, Ala, Thr, Gly, or Val
  VARIANT (1407)..(1407): Lys, Ser, Ala, Thr, Gly, or Val
  VARIANT (1409)..(1409): Lys, Ser, Ala, Thr, Gly, or Val
  VARIANT (1411)..(1411): Lys, Ser, Ala, Thr, Gly, or Val
  VARIANT (1413)..(1413): Lys, Ser, Ala, Thr, Gly, or Val
  VARIANT (1415)..(1415): Lys, Ser, Ala, Thr, Gly, or Val
  VARIANT (1417)..(1417): Lys, Ser, Ala, Thr, Gly, or Val
  VARIANT (1419)..(1419): Lys, Ser, Ala, Thr, Gly, or Val
  VARIANT (1421)..(1421): Lys, Ser, Ala, Thr, Gly, or Val
  VARIANT (1423)..(1423): Lys, Ser, Ala, Thr, Gly, or Val
  VARIANT (1425)..(1425): Lys, Ser, Ala, Thr, Gly, or Val
  VARIANT (1427)..(1427): Lys, Ser, Ala, Thr, Gly, or Val
  VARIANT (1429)..(1429): Lys, Ser, Ala, Thr, Gly, or Val
  VARIANT (1431)..(1431): Lys, Ser, Ala, Thr, Gly, or Val
  VARIANT (1433)..(1433): Lys, Ser, Ala, Thr, Gly, or Val
  VARIANT (1435)..(1435): Lys, Ser, Ala, Thr, Gly, or Val
  VARIANT (1437)..(1437): Lys, Ser, Ala, Thr, Gly, or Val
  VARIANT (1439)..(1439): Lys, Ser, Ala, Thr, Gly, or Val
  VARIANT (1441)..(1441): Lys, Ser, Ala, Thr, Gly, or Val
  VARIANT (1443)..(1443): Lys, Ser, Ala, Thr, Gly, or Val
  VARIANT (1445)..(1445): Lys, Ser, Ala, Thr, Gly, or Val
  VARIANT (1447)..(1447): Lys, Ser, Ala, Thr, Gly, or Val
  VARIANT (1449)..(1449): Lys, Ser, Ala, Thr, Gly, or Val
  VARIANT (1451)..(1451): Lys, Ser, Ala, Thr, Gly, or Val
  VARIANT (1453)..(1453): Lys, Ser, Ala, Thr, Gly, or Val
  VARIANT (1455)..(1455): Lys, Ser, Ala, Thr, Gly, or Val
  VARIANT (1457)..(1457): Lys, Ser, Ala, Thr, Gly, or Val
  VARIANT (1459)..(1459): Lys, Ser, Ala, Thr, Gly, or Val
  VARIANT (1461)..(1461): Lys, Ser, Ala, Thr, Gly, or Val
  VARIANT (1463)..(1463): Lys, Ser, Ala, Thr, Gly, or Val
  VARIANT (1465)..(1465): Lys, Ser, Ala, Thr, Gly, or Val
  VARIANT (1467)..(1467): Lys, Ser, Ala, Thr, Gly, or Val
  VARIANT (1469)..(1469): Lys, Ser, Ala, Thr, Gly, or Val
  VARIANT (1471)..(1471): Lys, Ser, Ala, Thr, Gly, or Val
  VARIANT (1473)..(1473): Lys, Ser, Ala, Thr, Gly, or Val
  VARIANT (1475)..(1475): Lys, Ser, Ala, Thr, Gly, or Val
  VARIANT (1477)..(1477): Lys, Ser, Ala, Thr, Gly, or Val
  VARIANT (1479)..(1479): Lys, Ser, Ala, Thr, Gly, or Val
  VARIANT (1481)..(1481): Lys, Ser, Ala, Thr, Gly, or Val
  VARIANT (1483)..(1483): Lys, Ser, Ala, Thr, Gly, or Val
  VARIANT (1485)..(1485): Lys, Ser, Ala, Thr, Gly, or Val
  VARIANT (1487)..(1487): Lys, Ser, Ala, Thr, Gly, or Val
  VARIANT (1489)..(1489): Lys, Ser, Ala, Thr, Gly, or Val
  VARIANT (1491)..(1491): Lys, Ser, Ala, Thr, Gly, or Val
  VARIANT (1493)..(1493): Lys, Ser, Ala, Thr, Gly, or Val
  VARIANT (1495)..(1495): Lys, Ser, Ala, Thr, Gly, or Val
  VARIANT (1497)..(1497): Lys, Ser, Ala, Thr, Gly, or Val
  VARIANT (1499)..(1499): Lys, Ser, Ala, Thr, Gly, or Val
  VARIANT (1501)..(1501): Lys, Ser, Ala, Thr, Gly, or Val
  VARIANT (1503)..(1503): Lys, Ser, Ala, Thr, Gly, or Val
  VARIANT (1505)..(1505): Lys, Ser, Ala, Thr, Gly, or Val
  VARIANT (1507)..(1507): Lys, Ser, Ala, Thr, Gly, or Val
  VARIANT (1509)..(1509): Lys, Ser, Ala, Thr, Gly, or Val
  VARIANT (1511)..(1511): Lys, Ser, Ala, Thr, Gly, or Val
  VARIANT (1513)..(1513): Lys, Ser, Ala, Thr, Gly, or Val
  VARIANT (1515)..(1515): Lys, Ser, Ala, Thr, Gly, or Val
  VARIANT (1517)..(1517): Lys, Ser, Ala, Thr, Gly, or Val
  VARIANT (1519)..(1519): Lys, Ser, Ala, Thr, Gly, or Val
  VARIANT (1521)..(1521): Lys, Ser, Ala, Thr, Gly, or Val
  VARIANT (1523)..(1523): Lys, Ser, Ala, Thr, Gly, or Val
  VARIANT (1525)..(1525): Lys, Ser, Ala, Thr, Gly, or Val
  VARIANT (1527)..(1527): Lys, Ser, Ala, Thr, Gly, or Val
  VARIANT (1529)..(1529): Lys, Ser, Ala, Thr, Gly, or Val
  VARIANT (1531)..(1531): Lys, Ser, Ala, Thr, Gly, or Val
  VARIANT (1533)..(1533): Lys, Ser, Ala, Thr, Gly, or Val
  VARIANT (1535)..(1535): Lys, Ser, Ala, Thr, Gly, or Val
  VARIANT (1537)..(1537): Lys, Ser, Ala, Thr, Gly, or Val
  VARIANT (1539)..(1539): Lys, Ser, Ala, Thr, Gly, or Val
  VARIANT (1541)..(1541): Lys, Ser, Ala, Thr, Gly, or Val
  VARIANT (1543)..(1543): Lys, Ser, Ala, Thr, Gly, or Val
  VARIANT (1545)..(1545): Lys, Ser, Ala, Thr, Gly, or Val
  VARIANT (1547)..(1547): Lys, Ser, Ala, Thr, Gly, or Val
  VARIANT (1549)..(1549): Lys, Ser, Ala, Thr, Gly, or Val
  VARIANT (1551)..(1551): Lys, Ser, Ala, Thr, Gly, or Val
  VARIANT (1553)..(1553): Lys, Ser, Ala, Thr, Gly, or Val
  VARIANT (1555)..(1555): Lys, Ser, Ala, Thr, Gly, or Val
  VARIANT (1557)..(1557): Lys, Ser, Ala, Thr, Gly, or Val
  VARIANT (1559)..(1559): Lys, Ser, Ala, Thr, Gly, or Val
  VARIANT (1561)..(1561): Lys, Ser, Ala, Thr, Gly, or Val
  VARIANT (1563)..(1563): Lys, Ser, Ala, Thr, Gly, or Val
  VARIANT (1565)..(1565): Lys, Ser, Ala, Thr, Gly, or Val
  VARIANT (1567)..(1567): Lys, Ser, Ala, Thr, Gly, or Val
  VARIANT (1569)..(1569): Lys, Ser, Ala, Thr, Gly, or Val
  VARIANT (1571)..(1571): Lys, Ser, Ala, Thr, Gly, or Val
  VARIANT (1573)..(1573): Lys, Ser, Ala, Thr, Gly, or Val
  VARIANT (1575)..(1575): Lys, Ser, Ala, Thr, Gly, or Val
  VARIANT (1577)..(1577): Lys, Ser, Ala, Thr, Gly, or Val
  VARIANT (1579)..(1579): Lys, Ser, Ala, Thr, Gly, or Val
  VARIANT (1581)..(1581): Lys, Ser, Ala, Thr, Gly, or Val
  VARIANT (1583)..(1583): Lys, Ser, Ala, Thr, Gly, or Val
  VARIANT (1585)..(1585): Lys, Ser, Ala, Thr, Gly, or Val
  VARIANT (1587)..(1587): Lys, Ser, Ala, Thr, Gly, or Val
  VARIANT (1589)..(1589): Lys, Ser, Ala, Thr, Gly, or Val
  VARIANT (1591)..(1591): Lys, Ser, Ala, Thr, Gly, or Val
  VARIANT (1593)..(1593): Lys, Ser, Ala, Thr, Gly, or Val
  VARIANT (1595)..(1595): Lys, Ser, Ala, Thr, Gly, or Val
  VARIANT (1597)..(1597): Lys, Ser, Ala, Thr, Gly, or Val
  VARIANT (1599)..(1599): Lys, Ser, Ala, Thr, Gly, or Val
  VARIANT (1601)..(1601): Lys, Ser, Ala, Thr, Gly, or Val
  VARIANT (1603)..(1603): Lys, Ser, Ala, Thr, Gly, or Val
  VARIANT (1605)..(1605): Lys, Ser, Ala, Thr, Gly, or Val
  VARIANT (1607)..(1607): Lys, Ser, Ala, Thr, Gly, or Val
  VARIANT (1609)..(1609): Lys, Ser, Ala, Thr, Gly, or Val
  VARIANT (1611)..(1611): Lys, Ser, Ala, Thr, Gly, or Val
  VARIANT (1613)..(1613): Lys, Ser, Ala, Thr, Gly, or Val
  VARIANT (1615)..(1615): Lys, Ser, Ala, Thr, Gly, or Val
  VARIANT (1617)..(1617): Lys, Ser, Ala, Thr, Gly, or Val
  VARIANT (1619)..(1619): Lys, Ser, Ala, Thr, Gly, or Val
  VARIANT (1621)..(1621): Lys, Ser, Ala, Thr, Gly, or Val
  VARIANT (1623)..(1623): Lys, Ser, Ala, Thr, Gly, or Val
  VARIANT (1625)..(1625): Lys, Ser, Ala, Thr, Gly, or Val
  VARIANT (1627)..(1627): Lys, Ser, Ala, Thr, Gly, or Val
  VARIANT (1629)..(1629): Lys, Ser, Ala, Thr, Gly, or Val
  VARIANT (1631)..(1631): Lys, Ser, Ala, Thr, Gly, or Val
  VARIANT (1633)..(1633): Lys, Ser, Ala, Thr, Gly, or Val
  VARIANT (1635)..(1635): Lys, Ser, Ala, Thr, Gly, or Val
  VARIANT (1637)..(1637): Lys, Ser, Ala, Thr, Gly, or Val
  VARIANT (1639)..(1639): Lys, Ser, Ala, Thr, Gly, or Val
  VARIANT (1641)..(1641): Lys, Ser, Ala, Thr, Gly, or Val
  VARIANT (1643)..(1643): Lys, Ser, Ala, Thr, Gly, or Val
  VARIANT (1645)..(1645): Lys, Ser, Ala, Thr, Gly, or Val
  VARIANT (1647)..(1647): Lys, Ser, Ala, Thr, Gly, or Val
  VARIANT (1649)..(1649): Lys, Ser, Ala, Thr, Gly, or Val
  VARIANT (1651)..(1651): Lys, Ser, Ala, Thr, Gly, or Val
  VARIANT (1653)..(1653): Lys, Ser, Ala, Thr, Gly, or Val
  VARIANT (1655)..(1655): Lys, Ser, Ala, Thr, Gly, or Val
  VARIANT (1657)..(1657): Lys, Ser, Ala, Thr, Gly, or Val
  VARIANT (1659)..(1659): Lys, Ser, Ala, Thr, Gly, or Val
  VARIANT (1661)..(1661): Lys, Ser, Ala, Thr, Gly, or Val
  VARIANT (1663)..(1663): Lys, Ser, Ala, Thr, Gly, or Val
  VARIANT (1665)..(1665): Lys, Ser, Ala, Thr, Gly, or Val
  VARIANT (1667)..(1667): Lys, Ser, Ala, Thr, Gly, or Val
  VARIANT (1669)..(1669): Lys, Ser, Ala, Thr, Gly, or Val
  VARIANT (1671)..(1671): Lys, Ser, Ala, Thr, Gly, or Val
  VARIANT (1673)..(1673): Lys, Ser, Ala, Thr, Gly, or Val
  VARIANT (1675)..(1675): Lys, Ser, Ala, Thr, Gly, or Val
  VARIANT (1677)..(1677): Lys, Ser, Ala, Thr, Gly, or Val
  VARIANT (1679)..(1679): Lys, Ser, Ala, Thr, Gly, or Val
  VARIANT (1681)..(1681): Lys, Ser, Ala, Thr, Gly, or Val
  VARIANT (1683)..(1683): Lys, Ser, Ala, Thr, Gly, or Val
  VARIANT (1685)..(1685): Lys, Ser, Ala, Thr, Gly, or Val
  VARIANT (1687)..(1687): Lys, Ser, Ala, Thr, Gly, or Val
  VARIANT (1689)..(1689): Lys, Ser, Ala, Thr, Gly, or Val
  VARIANT (1691)..(1691): Lys, Ser, Ala, Thr, Gly, or Val
  VARIANT (1693)..(1693): Lys, Ser, Ala, Thr, Gly, or Val
  VARIANT (1695)..(1695): Lys, Ser, Ala, Thr, Gly, or Val
  VARIANT (1697)..(1697): Lys, Ser, Ala, Thr, Gly, or Val
  VARIANT (1699)..(1699): Lys, Ser, Ala, Thr, Gly, or Val
  VARIANT (1701)..(1701): Lys, Ser, Ala, Thr, Gly, or Val
  VARIANT (1703)..(1703): Lys, Ser, Ala, Thr, Gly, or Val
  VARIANT (1705)..(1705): Lys, Ser, Ala, Thr, Gly, or Val
  VARIANT (1707)..(1707): Lys, Ser, Ala, Thr, Gly, or Val
  VARIANT (1709)..(1709): Lys, Ser, Ala, Thr, Gly, or Val
  VARIANT (1711)..(1711): Lys, Ser, Ala, Thr, Gly, or Val
  VARIANT (1713)..(1713): Lys, Ser, Ala, Thr, Gly, or Val
  VARIANT (1715)..(1715): Lys, Ser, Ala, Thr, Gly, or Val
  VARIANT (1717)..(1717): Lys, Ser, Ala, Thr, Gly, or Val
  VARIANT (1719)..(1719): Lys, Ser, Ala, Thr, Gly, or Val
  VARIANT (1721)..(1721): Lys, Ser, Ala, Thr, Gly, or Val
  VARIANT (1723)..(1723): Lys, Ser, Ala, Thr, Gly, or Val
  VARIANT (1725)..(1725): Lys, Ser, Ala, Thr, Gly, or Val
  VARIANT (1727)..(1727): Lys, Ser, Ala, Thr, Gly, or Val
  VARIANT (1729)..(1729): Lys, Ser, Ala, Thr, Gly, or Val
  VARIANT (1731)..(1731): Lys, Ser, Ala, Thr, Gly, or Val
  VARIANT (1733)..(1733): Lys, Ser, Ala, Thr, Gly, or Val
  VARIANT (1735)..(1735): Lys, Ser, Ala, Thr, Gly, or Val
  VARIANT (1737)..(1737): Lys, Ser, Ala, Thr, Gly, or Val
  VARIANT (1739)..(1739): Lys, Ser, Ala, Thr, Gly, or Val
  VARIANT (1741)..(1741): Lys, Ser, Ala, Thr, Gly, or Val
  VARIANT (1743)..(1743): Lys, Ser, Ala, Thr, Gly, or Val
  VARIANT (1745)..(1745): Lys, Ser, Ala, Thr, Gly, or Val
  VARIANT (1747)..(1747): Lys, Ser, Ala, Thr, Gly, or Val
  VARIANT (1749)..(1749): Lys, Ser, Ala, Thr, Gly, or Val
  VARIANT (1751)..(1751): Lys, Ser, Ala, Thr, Gly, or Val
  VARIANT (1753)..(1753): Lys, Ser, Ala, Thr, Gly, or Val
  VARIANT (1755)..(1755): Lys, Ser, Ala, Thr, Gly, or Val
  VARIANT (1757)..(1757): Lys, Ser, Ala, Thr, Gly, or Val
  VARIANT (1759)..(1759): Lys, Ser, Ala, Thr, Gly, or Val
  VARIANT (1761)..(1761): Lys, Ser, Ala, Thr, Gly, or Val
  VARIANT (1763)..(1763): Lys, Ser, Ala, Thr, Gly, or Val
  VARIANT (1765)..(1765): Lys, Ser, Ala, Thr, Gly, or Val
  VARIANT (1767)..(1767): Lys, Ser, Ala, Thr, Gly, or Val
  VARIANT (1769)..(1769): Lys, Ser, Ala, Thr, Gly, or Val
  VARIANT (1771)..(1771): Lys, Ser, Ala, Thr, Gly, or Val
  VARIANT (1773)..(1773): Lys, Ser, Ala, Thr, Gly, or Val
  VARIANT (1775)..(1775): Lys, Ser, Ala, Thr, Gly, or Val
  VARIANT (1777)..(1777): Lys, Ser, Ala, Thr, Gly, or Val
  VARIANT (1779)..(1779): Lys, Ser, Ala, Thr, Gly, or Val
  VARIANT (1781)..(1781): Lys, Ser, Ala, Thr, Gly, or Val
  VARIANT (1783)..(1783): Lys, Ser, Ala, Thr, Gly, or Val
  VARIANT (1785)..(1785): Lys, Ser, Ala, Thr, Gly, or Val
  VARIANT (1787)..(1787): Lys, Ser, Ala, Thr, Gly, or Val
  VARIANT (1789)..(1789): Lys, Ser, Ala, Thr, Gly, or Val
  VARIANT (1791)..(1791): Lys, Ser, Ala, Thr, Gly, or Val
  VARIANT (1793)..(1793): Lys, Ser, Ala, Thr, Gly, or Val
  VARIANT (1795)..(1795): Lys, Ser, Ala, Thr, Gly, or Val
  VARIANT (1797)..(1797): Lys, Ser, Ala, Thr, Gly, or Val
  VARIANT (1799)..(1799): Lys, Ser, Ala, Thr, Gly, or Val
  VARIANT (1801)..(1801): Lys, Ser, Ala, Thr, Gly, or Val
  VARIANT (1803)..(1803): Lys, Ser, Ala, Thr, Gly, or Val
  VARIANT (1805)..(1805): Lys, Ser, Ala, Thr, Gly, or Val
  VARIANT (1807)..(1807): Lys, Ser, Ala, Thr, Gly, or Val
  VARIANT (1809)..(1809): Lys, Ser, Ala, Thr, Gly, or Val
  VARIANT (1811)..(1811): Lys, Ser, Ala, Thr, Gly, or Val
  VARIANT (1813)..(1813): Lys, Ser, Ala, Thr, Gly, or Val
  VARIANT (1815)..(1815): Lys, Ser, Ala, Thr, Gly, or Val
  VARIANT (1817)..(1817): Lys, Ser, Ala, Thr, Gly, or Val
  VARIANT (1819)..(1819): Lys, Ser, Ala, Thr, Gly, or Val
  VARIANT (1821)..(1821): Lys, Ser, Ala, Thr, Gly, or Val
  VARIANT (1823)..(1823): Lys, Ser, Ala, Thr, Gly, or Val
  VARIANT (1825)..(1825): Lys, Ser, Ala, Thr, Gly, or Val
  VARIANT (1827)..(1827): Lys, Ser, Ala, Thr, Gly, or Val
  VARIANT (1829)..(1829): Lys, Ser, Ala, Thr, Gly, or Val
  VARIANT (1831)..(1831): Lys, Ser, Ala, Thr, Gly, or Val
  VARIANT (1833)..(1833): Lys, Ser, Ala, Thr, Gly, or Val
  VARIANT (1835)..(1835): Lys, Ser, Ala, Thr, Gly, or Val
  VARIANT (1837)..(1837): Lys, Ser, Ala, Thr, Gly, or Val
  VARIANT (1839)..(1839): Lys, Ser, Ala, Thr, Gly, or Val
  VARIANT (1841)..(1841): Lys, Ser, Ala, Thr, Gly, or Val
  VARIANT (1843)..(1843): Lys, Ser, Ala, Thr, Gly, or Val
  VARIANT (1845)..(1845): Lys, Ser, Ala, Thr, Gly, or Val
  VARIANT (1847)..(1847): Lys, Ser, Ala, Thr, Gly, or Val
  VARIANT (1849)..(1849): Lys, Ser, Ala, Thr, Gly, or Val
  VARIANT (1851)..(1851): Lys, Ser, Ala, Thr, Gly, or Val
  VARIANT (1853)..(1853): Lys, Ser, Ala, Thr, Gly, or Val
  VARIANT (1855)..(1855): Lys, Ser, Ala, Thr, Gly, or Val
  VARIANT (1857)..(1857): Lys, Ser, Ala, Thr, Gly, or Val
  VARIANT (1859)..(1859): Lys, Ser, Ala, Thr, Gly, or Val
  VARIANT (1861)..(1861): Lys, Ser, Ala, Thr, Gly, or Val
  VARIANT (1863)..(1863): Lys, Ser, Ala, Thr, Gly, or Val
  VARIANT (1865)..(1865): Lys, Ser, Ala, Thr, Gly, or Val
  VARIANT (1867)..(1867): Lys, Ser, Ala, Thr, Gly, or Val
  VARIANT (1869)..(1869): Lys, Ser, Ala, Thr, Gly, or Val
  VARIANT (1871)..(1871): Lys, Ser, Ala, Thr, Gly, or Val
  VARIANT (1873)..(1873): Lys, Ser, Ala, Thr, Gly, or Val
  VARIANT (1875)..(1875): Lys, Ser, Ala, Thr, Gly, or Val
  VARIANT (1877)..(1877): Lys, Ser, Ala, Thr, Gly, or Val
  VARIANT (1879)..(1879): Lys, Ser, Ala, Thr, Gly, or Val
  VARIANT (1881)..(1881): Lys, Ser, Ala, Thr, Gly, or Val
  VARIANT (1883)..(1883): Lys, Ser, Ala, Thr, Gly, or Val
  VARIANT (1885)..(1885): Lys, Ser, Ala, Thr, Gly, or Val
  VARIANT (1887)..(1887): Lys, Ser, Ala, Thr, Gly, or Val
  VARIANT (1889)..(1889): Lys, Ser, Ala, Thr, Gly, or Val
  VARIANT (1891)..(1891): Lys, Ser, Ala, Thr, Gly, or Val
  VARIANT (1893)..(1893): Lys, Ser, Ala, Thr, Gly, or Val
  VARIANT (1895)..(1895): Lys, Ser, Ala, Thr, Gly, or Val
  VARIANT (1897)..(1897): Lys, Ser, Ala, Thr, Gly, or Val
  VARIANT (1899)..(1899): Lys, Ser, Ala, Thr, Gly, or Val
  VARIANT (1901)..(1901): Lys, Ser, Ala, Thr, Gly, or Val
  VARIANT (1903)..(1903): Lys, Ser, Ala, Thr, Gly, or Val
  VARIANT (1905)..(1905): Lys, Ser, Ala, Thr, Gly, or Val
  VARIANT (1907)..(1907): Lys, Ser, Ala, Thr, Gly, or Val
  VARIANT (1909)..(1909): Lys, Ser, Ala, Thr, Gly, or Val
  VARIANT (1911)..(1911): Lys, Ser, Ala, Thr, Gly, or Val
  VARIANT (1913)..(1913): Lys, Ser, Ala, Thr, Gly, or Val
  VARIANT (1915)..(1915): Lys, Ser, Ala, Thr, Gly, or Val
  VARIANT (1917)..(1917): Lys, Ser, Ala, Thr, Gly, or Val
  VARIANT (1919)..(1919): Lys, Ser, Ala, Thr, Gly, or Val
  VARIANT (1921)..(1921): Lys, Ser, Ala, Thr, Gly, or Val
  VARIANT (1923)..(1923): Lys, Ser, Ala, Thr, Gly, or Val
  VARIANT (1925)..(1925): Lys, Ser, Ala, Thr, Gly, or Val
  VARIANT (1927)..(1927): Lys, Ser, Ala, Thr, Gly, or Val
  VARIANT (1929)..(1929): Lys, Ser, Ala, Thr, Gly, or Val
  VARIANT (1931)..(1931): Lys, Ser, Ala, Thr, Gly, or Val
  VARIANT (1933)..(1933): Lys, Ser, Ala, Thr, Gly, or Val
  VARIANT (1935)..(1935): Lys, Ser, Ala, Thr, Gly, or Val
  VARIANT (1937)..(1937): Lys, Ser, Ala, Thr, Gly, or Val
  VARIANT (1939)..(1939): Lys, Ser, Ala, Thr, Gly, or Val
  VARIANT (1941)..(1941): Lys, Ser, Ala, Thr, Gly, or Val
  VARIANT (1943)..(1943): Lys, Ser, Ala, Thr, Gly, or Val
  VARIANT (1945)..(1945): Lys, Ser, Ala, Thr, Gly, or Val
  VARIANT (1947)..(1947): Lys, Ser, Ala, Thr, Gly, or Val
  VARIANT (1949)..(1949): Lys, Ser, Ala, Thr, Gly, or Val
  VARIANT (1951)..(1951): Lys, Ser, Ala, Thr, Gly, or Val
  VARIANT (1953)..(1953): Lys, Ser, Ala, Thr, Gly, or Val
  VARIANT (1955)..(1955): Lys, Ser, Ala, Thr, Gly, or Val
  VARIANT (1957)..(1957): Lys, Ser, Ala, Thr, Gly, or Val
  VARIANT (1959)..(1959): Lys, Ser, Ala, Thr, Gly, or Val
  VARIANT (1961)..(1961): Lys, Ser, Ala, Thr, Gly, or Val
  VARIANT (1963)..(1963): Lys, Ser, Ala, Thr, Gly, or Val
  VARIANT (1965)..(1965): Lys, Ser, Ala, Thr, Gly, or Val
  VARIANT (1967)..(1967): Lys, Ser, Ala, Thr, Gly, or Val
  VARIANT (1969)..(1969): Lys, Ser, Ala, Thr, Gly, or Val
  VARIANT (1971)..(1971): Lys, Ser, Ala, Thr, Gly, or Val
  VARIANT (1973)..(1973): Lys, Ser, Ala, Thr, Gly, or Val
  VARIANT (1975)..(1975): Lys, Ser, Ala, Thr, Gly, or Val
  VARIANT (1977)..(1977): Lys, Ser, Ala, Thr, Gly, or Val
  VARIANT (1979)..(1979): Lys, Ser, Ala, Thr, Gly, or Val
  VARIANT (1981)..(1981): Lys, Ser, Ala, Thr, Gly, or Val
  VARIANT (1983)..(1983): Lys, Ser, Ala, Thr, Gly, or Val
  VARIANT (1985)..(1985): Lys, Ser, Ala, Thr, Gly, or Val
  VARIANT (1987)..(1987): Lys, Ser, Ala, Thr, Gly, or Val
  VARIANT (1989)..(1989): Lys, Ser, Ala, Thr, Gly, or Val
  VARIANT (1991)..(1991): Lys, Ser, Ala, Thr, Gly, or Val
  VARIANT (1993)..(1993): Lys, Ser, Ala, Thr, Gly, or Val
  VARIANT (1995)..(1995): Lys, Ser, Ala, Thr, Gly, or Val
  VARIANT (1997)..(1997): Lys, Ser, Ala, Thr, Gly, or Val
  VARIANT (1999)..(1999): Lys, Ser, Ala, Thr, Gly, or Val
  This sequence encompasses at least 1 to 1,000 (Xaa-Pro) repeating units, and subject to having the minumum number of repeating units, any one or more repeating units can either be present or absent

SEQ ID NO: 12 - DNA, 87 bp, Artificial Sequence
  Description of Artificial Sequence: Synthetic nucleotide sequence
taaaagcttccggagtgccggccctcatagcccacctccaccattatcaccatcacctactccaactcctcctttgggaccacacag

SEQ ID NO: 13 - DNA, 86 bp, Artificial Sequence
  Description of Artificial Sequence: Synthetic nucleotide sequence
aatagaattcgaccggtaccccgggaggtggtgttggggttggtgaaggggaaagtgtagggggtggactgtgtggtcccaaagga

SEQ ID NO: 14 - DNA, 61 bp, Artificial Sequence
  Description of Artificial Sequence: Synthetic nucleotide sequence
ttcaagcttaccggtctccggaacaccattacccactttgaccccacttcctgccccaact

SEQ ID NO: 15 - DNA, 63 bp, Artificial Sequence
  Description of Artificial Sequence: Synthetic nucleotide sequence
tgagaattccatggtccgcccggggtgtggtaaaagaggtggagttggggcaggaagtggggt

SEQ ID NO: 16 - DNA, 293 bp, Artificial Sequence
  Description of Artificial Sequence: Synthetic nucleotide construct
  CDS (27)..(293)
ctgacagaggatccgcaatgggaaaaatggcttctctatttgccacatttttagtggttttagtgtcacttagcttagcacaaacaacccgggactcaccctcaccaactcctaccgcaccacctggtccacactcaccaccaccaacattgtcaccctcaccaactcctaccgcaccacctggtccacactcaccaccaccaacattgtcaccctcaccaactcctaccgcaccacctggtccacactcaccaccaccaacattgtcaccctcaccggtcgccaccatggtg

SEQ ID NO: 17 - protein, 89 aa, Artificial Sequence
  Description of Artificial Sequence: Synthetic amino acid construct
MASLFATFLVVLVSLSLAQTTRDSPSPTPTAPPGPHSPPPTLSPSPTPTAPPGPHSPPPTLSPSPTPTAPPGPHSPPPTLSPSPVATMV

SEQ ID NO: 18 - DNA, 43 bp, Artificial Sequence
  Description of Artificial Sequence: Synthetic nucleotide sequence
  CDS (1)..(9)
ctgtacaagtaaagcggccgccaccgcggaggagctcgaatcg

SEQ ID NO: 19 - protein, 3 aa, Artificial Sequence
  Description of Artificial Sequence: Synthetic peptide
LYK

SEQ ID NO: 20 - DNA, 575 bp, Artificial Sequence
  Description of Artificial Sequence: Synthetic nucleotide construct
  CDS (27)..(575)
ctgacagaggatccgcaatgggaaaaatggcttctctatttgccacatttttagtggttttagtgtcacttagcttagcacaaacaacccggagtgccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggggtaccggtcaccatggtg

SEQ ID NO: 21 - protein, 183 aa, Artificial Sequence
  Description of Artificial Sequence: Synthetic amino acid construct
MASLFATFLVVLVSLSLAQTTRSAGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGVPVTMV

SEQ ID NO: 22 - DNA, 43 bp, Artificial Sequence; identical to SEQ ID NO: 18
  Description of Artificial Sequence: Synthetic nucleotide sequence
  CDS (1)..(9)

SEQ ID NO: 23 - protein, 3 aa, Artificial Sequence
  Description of Artificial Sequence: Synthetic peptide
LYK

SEQ ID NO: 24 - DNA, 374 bp, Artificial Sequence
  Description of Artificial Sequence: Synthetic nucleotide construct
  CDS (27)..(374)
ctgacagaggatccgcaatgggaaaaatggcttctctatttgccacatttttagtggttttagtgtcacttagcttagcacaaacaacccgggactcaccggtctccggaacaccattacccactttgaccccacttcctgccccaactccacctcttttaccacaccccggaacaccattacccactttgaccccacttcctgccccaactccacctcttttaccacaccccggaacaccattacccactttgaccccacttcctgccccaactccacctcttttaccacaccccggaacaccattacccactttgaccccacttcctgccccaactccacctcttttaccacaccccgggcggaccatggtg

SEQ ID NO: 25 - protein, 116 aa, Artificial Sequence
  Description of Artificial Sequence: Synthetic amino acid construct
MASLFATFLVVLVSLSLAQTTRDSPVSGTPLPTLTPLPAPTPPLLPHPGTPLPTLTPLPAPTPPLLPHPGTPLPTLTPLPAPTPPLLPHPGTPLPTLTPLPAPTPPLLPHPGRTMV

SEQ ID NO: 26 - DNA, 626 bp, Artificial Sequence
  Description of Artificial Sequence: Synthetic nucleotide construct
  CDS (27)..(626)
ctgacagaggatccgcaatgggaaaaatggcttctctatttgccacatttttagtggttttagtgtcacttagcttagcacaaacaacccgggactcaccggtctccggaacaccattacccactttgaccccacttcctgccccaactccacctcttttaccacaccccggaacaccattacccactttgaccccacttcctgccccaactccacctcttttaccacaccccggaacaccattacccactttgaccccacttcctgccccaactccacctcttttaccacaccccggaacaccattacccactttgaccccacttcctgccccaactccacctcttttaccacaccccggaacaccattacccactttgaccccacttcctgccccaactccacctcttttaccacaccccggaacaccattacccactttgaccccacttcctgccccaactccacctcttttaccacaccccggaacaccattacccactttgaccccacttcctgccccaactccacctcttttaccacaccccggaacaccattacccactttgaccccacttcctgccccaactccacctcttttaccacaccccgggcggaccatggtg

SEQ ID NO: 27 - protein, 200 aa, Artificial Sequence
  Description of Artificial Sequence: Synthetic amino acid construct
MASLFATFLVVLVSLSLAQTTRDSPVSGTPLPTLTPLPAPTPPLLPHPGTPLPTLTPLPAPTPPLLPHPGTPLPTLTPLPAPTPPLLPHPGTPLPTLTPLPAPTPPLLPHPGTPLPTLTPLPAPTPPLLPHPGTPLPTLTPLPAPTPPLLPHPGTPLPTLTPLPAPTPPLLPHPGTPLPTLTPLPAPTPPLLPHPGRTMV

SEQ ID NO: 28 - DNA, 38 bp, Artificial Sequence
  Description of Artificial Sequence: Synthetic nucleotide sequence
  CDS (1)..(9)
ctgtacaagtaaagcggccgccaccgcggaggagctcg

SEQ ID NO: 29 - protein, 3 aa, Artificial Sequence
  Description of Artificial Sequence: Synthetic peptide
LYK

SEQ ID NO: 30 - DNA, 710 bp, Artificial Sequence
  Description of Artificial Sequence: Synthetic nucleotide construct
  CDS (27)..(710)
ctgacagaggatccgcaatgggaaaaatggcttctctatttgccacatttttagtggttttagtgtcacttagcttagcacaaacaacccggagtgccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggggtaccggtctccggaacaccattacccactttgaccccacttcctgccccaactccacctcttttaccacaccccggaacaccattacccactttgaccccacttcctgccccaactccacctcttttaccacaccccgggcggaccatggtg

SEQ ID NO: 31 - protein, 228 aa, Artificial Sequence
  Description of Artificial Sequence: Synthetic amino acid construct
MASLFATFLVVLVSLSLAQTTRSAGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGVPVSGTPLPTLTPLPAPTPPLLPHPGTPLPTLTPLPAPTPPLLPHPGRTMV

SEQ ID NO: 32 - DNA, 1064 bp, Artificial Sequence
  Description of Artificial Sequence: Synthetic nucleotide construct
  CDS (27)..(1064)
ctgacagaggatccgcaatgggaaaaatggcttctctatttgccacatttttagtggttttagtgtcacttagcttagcacaaacaacccggagtgccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggggtaccggtctccggaacaccattacccactttgaccccacttcctgccccaactccacctcttttaccacaccccggaacaccattacccactttgaccccacttcctgccccaactccacctcttttaccacaccccggaacaccattacccactttgaccccacttcctgccccaactccacctcttttaccacaccccggaacaccattacccactttgaccccacttcctgccccaactccacctcttttaccacaccccgggcggaccatggtg

SEQ ID NO: 33 - protein, 346 aa, Artificial Sequence
  Description of Artificial Sequence: Synthetic amino acid construct
MASLFATFLVVLVSLSLAQTTRSAGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGVPVSGTPLPTLTPLPAPTPPLLPHPGTPLPTLTPLPAPTPPLLPHPGTPLPTLTPLPAPTPPLLPHPGTPLPTLTPLPAPTPPLLPHPGRTMV

SEQ ID NO: 34 - DNA, 43 bp, Artificial Sequence; identical to SEQ ID NO: 18
  Description of Artificial Sequence: Synthetic nucleotide sequence
  CDS (1)..(9)

SEQ ID NO: 35 - protein, 3 aa, Artificial Sequence
  Description of Artificial Sequence: Synthetic peptide
LYK

SEQ ID NO: 36 - DNA, 33 bp, Artificial Sequence
  Description of Artificial Sequence: Synthetic primer
aatacccgggccttcccaaccattcccttatcc

SEQ ID NO: 37 - DNA, 32 bp, Artificial Sequence
  Description of Artificial Sequence: Synthetic primer
gattccatggtgaagccacagctgccctccac

SEQ ID NO: 38 - DNA, 93 bp, Artificial Sequence
  Description of Artificial Sequence: Synthetic vector
accatggcttcaccctctccaagcccttccccatcgcctagtccctcaccatccccttctcccagcccagacgatgatgacaaatccatggtg

SEQ ID NO: 39 - DNA, 87 bp, Artificial Sequence
  Description of Artificial Sequence: Synthetic nucleotide sequence
ttcaccatggcttcaccctctccaagcccttccccatcgcctagtccctcaccatccccttctcccagcccatagctgtacaagatt

SEQ ID NO: 40 - DNA, 33 bp, Artificial Sequence
  Description of Artificial Sequence: Synthetic primer
aatacccgggcctgtgatctgcctcaaacccac

SEQ ID NO: 41 - DNA, 33 bp, Artificial Sequence
  Description of Artificial Sequence: Synthetic primer
gaagccatggtttccttacttcttaaactttct

SEQ ID NO: 42 - DNA, 32 bp, Artificial Sequence
  Description of Artificial Sequence: Synthetic primer
aatacccgggatgcacacaagagtgaggttgc

SEQ ID NO: 43 - DNA, 33 bp, Artificial Sequence
  Description of Artificial Sequence: Synthetic primer
aactaggccttaagcctaaggcagcttgacttg

SEQ ID NO: 44 - DNA, 32 bp, Artificial Sequence
  Description of Artificial Sequence: Synthetic primer
gaagccatggttctctgtttggcagacgaagc

SEQ ID NO: 45 - DNA, 763 bp, Artificial Sequence
  Description of Artificial Sequence: Synthetic nucleotide construct
  CDS (13)..(720)
agaggatccgcaatgggaaaaatggcttctctatttgccacatttttagtggttttagtgtcacttagcttagcacaaacaaccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctcaccctctccaagcccttccccatcgcctagtccctcaccatccccttctcccagcccatagctgtacaagtaaagcggccgccaccgcggaggagctcgaatcg

SEQ ID NO: 46 - protein, 235 aa, Artificial Sequence
  Description of Artificial Sequence: Synthetic protein construct
MGKMASLFATFLVVLVSLSLAQTTFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFSPSPSPSPSPSPSPSPSPSP

SEQ ID NO: 47 - DNA, 48 bp, Artificial Sequence
  Description of Artificial Sequence: Synthetic oligonucleotide
ttcaccatggcttcaccctctccaagcccttccccatcgcctagtccc

SEQ ID NO: 48 - DNA, 57 bp, Artificial Sequence
  Description of Artificial Sequence: Synthetic oligonucleotide
aatcttgtacagctatgggctgggagaaggggatggtgagggactaggcgatgggga

SEQ ID NO: 49 - DNA, 87 bp, Artificial Sequence; identical to SEQ ID NO: 39
  Description of Artificial Sequence: Synthetic oligonucleotide
  CDS (13)..(72)

SEQ ID NO: 50 - DNA, 87 bp, Artificial Sequence
  Description of Artificial Sequence: Synthetic oligonucleotide
aatcttgtacagctatgggctgggagaaggggatggtgagggactaggcgatggggaagggcttggagagggtgaagccatggtgaa

SEQ ID NO: 51 - protein, 20 aa, Artificial Sequence
  Description of Artificial Sequence: Synthetic peptide
SPSPSPSPSPSPSPSPSPSP

SEQ ID NO: 52 - DNA, 69 bp, Artificial Sequence
  Description of Artificial Sequence: Synthetic oligonucleotide
aattaccatggatttgtcatcatcgtctgggctgggagaaggggatggtgagggactaggcgatgggga

SEQ ID NO: 53 - DNA, 99 bp, Artificial Sequence
  Description of Artificial Sequence: Synthetic nucleotide sequence
  CDS (13)..(87)
ttcaccatggcttcaccctctccaagcccttccccatcgcctagtcccagtccatccccatctcccagcccagacgatgatgacaaatccatggtaatt

SEQ ID NO: 54 - DNA, 99 bp, Artificial Sequence
  Description of Artificial Sequence: Synthetic oligonucleotide
aattaccatggatttgtcatcatcgtctgggctgggagaaggggatggactgggactaggcgatggggaagggcttggagagggtgaagccatggtgaa

SEQ ID NO: 55 - protein, 25 aa, Artificial Sequence
  Description of Artificial Sequence: Synthetic peptide
SPSPSPSPSPSPSPSPSPSPDDDDK

SEQ ID NO: 56 - DNA, 756 bp, Artificial Sequence
  Description of Artificial Sequence: Synthetic nucleotide construct
  CDS (13)..(756)
agaggatccgcaatgggaaaaatggcttctctatttgccacatttttagtggttttagtgtcacttagcttagcacaaacaacccgggccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttcaccatggcttcaccctctccaagcccttccccatcgcctagtccctcaccatccccttctcccagcccagacgatgatgacaaatccatggtg

SEQ ID NO: 57 - protein, 248 aa, Artificial Sequence
  Description of Artificial Sequence: Synthetic amino acid construct
MGKMASLFATFLVVLVSLSLAQTTRAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFTMASPSPSPSPSPSPSPSPSPSPDDDDKSMV

SEQ ID NO: 58 - DNA, 43 bp, Artificial Sequence; identical to SEQ ID NO: 18
  Description of Artificial Sequence: Synthetic nucleotide sequence
  CDS (1)..(9)

SEQ ID NO: 59 - protein, 3 aa, Artificial Sequence
  Description of Artificial Sequence: Synthetic peptide
LYK

SEQ ID NO: 60 - DNA, 1942 bp, Artificial Sequence
  Description of Artificial Sequence: Synthetic nucleotide construct
  CDS (13)..(1896)
agaggatccgcaatgggaaaaatggcttctctatttgccacatttttagtggttttagtgtcacttagcttagcacaaacaaccgatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacgttcaccttccatgcagatatatgcacatctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttatcaccctctccaagcccttccccatcgcctagtccctcaccatccccttctcccagcccatagctgtacaagtaaagcggccgccaccgcggaggagctcgaatcg

SEQ ID NO: 61 - protein, 628 aa, Artificial Sequence
  Description of Artificial Sequence: Synthetic amino acid construct
MGKMASLFATFLVVLVSLSLAQTTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTSEKERQIKKQTALVELVKHKPKATKEQLKAVMDDFAAFVEKCCKADDKETCFAEEGKKLVAASQAALGLSPSPSPSPSPSPSPSPSPSP

SEQ ID NO: 62 - DNA, 781 bp, Artificial Sequence
  Description of Artificial Sequence: Synthetic nucleotide construct
  CDS (13)..(735)
agaggatccgcaatgggaaaaatggcttctctatttgccacatttttagtggttttagtgtcacttagcttagcacaaacaaccgatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagatcaccctctccaagcccttccccatcgcctagtccctcaccatccccttctcccagcccatagctgtacaagtaaagcggccgccaccgcggaggagctcgaatcg

SEQ ID NO: 63 - protein, 241 aa, Artificial Sequence
  Description of Artificial Sequence: Synthetic amino acid construct
MGKMASLFATFLVVLVSLSLAQTTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRSPSPSPSPSPSPSPSPSPSP

SEQ ID NO: 64 - DNA, 685 bp, Artificial Sequence
  Description of Artificial Sequence: Synthetic nucleotide construct
  CDS (13)..(639)
agaggatccgcaatgggaaaaatggcttctctatttgccacatttttagtggttttagtgtcacttagcttagcacaaacaacctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatcaccctctccaagcccttccccatcgcctagtccctcaccatccccttctcccagcccatgactgtacaagtaaagcggccgccaccgcggaggagctcgaatcg

SEQ ID NO: 65 - protein, 209 aa, Artificial Sequence
  Description of Artificial Sequence: Synthetic amino acid construct
MGKMASLFATFLVVLVSLSLAQTTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESPSPSPSPSPSPSPSPSPSP

SEQ ID NO: 66 - DNA, 713 bp, Artificial Sequence
  Description of Artificial Sequence: Synthetic nucleotide construct
  CDS (26)..(667)
ctgcaggcgctctagaggatccgcaatgggaaaaatggcttctctatttgccacatttttagtggttttagtgtcacttagcttagcattcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctcaccctgactgtacaagtaaagcggccgccaccgcggaggagctcgaatcg

SEQ ID NO: 67 - protein, 214 aa, Artificial Sequence
  Description of Artificial Sequence: Synthetic amino acid construct
MGKMASLFATFLVVLVSLSLAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFSP

SEQ ID NO: 68 - DNA, 719 bp, Artificial Sequence
  Description of Artificial Sequence: Synthetic nucleotide construct
  CDS (26)..(673)
ctgcaggcgctctagaggatccgcaatgggaaaaatggcttctctatttgccacatttttagtggttttagtgtcacttagcttagcattcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctcaccctctccatgactgtacaagtaaagcggccgccaccgcggaggagctcgaatcg

SEQ ID NO: 69 - protein, 216 aa, Artificial Sequence
  Description of Artificial Sequence: Synthetic amino acid construct
MGKMASLFATFLVVLVSLSLAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFSPSP

SEQ ID NO: 70 - DNA, 737 bp, Artificial Sequence
  Description of Artificial Sequence: Synthetic nucleotide construct
  CDS (26)..(688)
ctgcaggcgctctagaggatccgcaatgggaaaaatggcttctctatttgccacatttttagtggttttagtgtcacttagcttagcattcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctcaccctctccaagcccttccccatcgccttgactgtacaagtaaagcggccgccaccgcggaggagctcgaatcg

SEQ ID NO: 71 - protein, 221 aa, Artificial Sequence
  Description of Artificial Sequence: Synthetic amino acid construct
MGKMASLFATFLVVLVSLSLAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFSPSPSPSPS

SEQ ID NO: 72 - DNA, 827 bp, Artificial Sequence
  Description of Artificial Sequence: Synthetic nucleotide construct
  CDS (26)..(781)
ctgcaggcgctctagaggatccgcaatgggaaaaatggcttctctatttgccacatttttagtggttttagtgtcacttagcttagcattcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctcaccctctccaagcccttccccatcgcctagtccctcaccatccccttctcccagcccatcaccctctccaagcccttccccatcgcctagtccctcaccatccccttctcccagcccatagctgtacaagtaaagcggccgccaccgcggaggagctcgaatcg

SEQ ID NO: 73 - protein, 252 aa, Artificial Sequence
  Description of Artificial Sequence: Synthetic amino acid construct
MGKMASLFATFLVVLVSLSLAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFSPSPSPSPSPSPSPSPSPSPSPSPSPSPSPSPSPSPSPSP

SEQ ID NO: 74 - DNA, 827 bp, Artificial Sequence
  Description of Artificial Sequence: Synthetic nucleotide construct
  CDS (26)..(781)
ctgcaggcgctctagaggatccgcaatgggaaaaatggcttctctatttgccacatttttagtggttttagtgtcacttagcttagcatcaccctctccaagcccttccccatcgcctagtccctcaccatccccttctcccagcccattcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctcaccctctccaagcccttccccatcgcctagtccctcaccatccccttctcccagcccatagctgtacaagtaaagcggccgccaccgcggaggagctcgaatcg

SEQ ID NO: 75 - protein, 252 aa, Artificial Sequence
  Description of Artificial Sequence: Synthetic amino acid construct
MGKMASLFATFLVVLVSLSLASPSPSPSPSPSPSPSPSPSPFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFSPSPSPSPSPSPSPSPSPSP

SEQ ID NO: 76 - DNA, 763 bp, Artificial Sequence
  Description of Artificial Sequence: Synthetic nucleotide construct
  CDS (13)..(717)
agaggatccgcaatgggaaaaatggcttctctatttgccacatttttagtggttttagtgtcacttagcttagcacaaacaaccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaaagatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctcaccctctccaagcccttccccatcgcctagtccctcaccatccccttctcccagcccatagctgtacaagtaaagcggccgccaccgcggaggagctcgaatcg

SEQ ID NO: 77 - protein, 235 aa, Artificial Sequence
  Description of Artificial Sequence: Synthetic nucleotide construct
MGKMASLFATFLVVLVSLSLAQTTFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEKIQTLMGRLEDGSPRTGQIFKQTYSKFDTNSHNDDALLKNYGLLYCFRKDMDKVETFLRIVQCRSVEGSCGFSPSPSPSPSPSPSPSPSPSP

SEQ ID NO: 78 - DNA, 664 bp, Artificial Sequence
  Description of Artificial Sequence: Synthetic nucleotide construct
  CDS (13)..(615)
agaggatccgcaatgggaaaaatggcttctctatttgccacatttttagtggttttagtgtcacttagcttagcacaaacaacccgggcctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatcaccctctccaagcccttccccatcgccttgactgtacaagtaaagcagcggccgccaccgcggaggagctcgaatcg

SEQ ID NO: 79 - protein, 201 aa, Artificial Sequence
  Description of Artificial Sequence: Synthetic amino acid construct
MGKMASLFATFLVVLVSLSLAQTTRACDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESPSPSPSPSP

SEQ ID NO: 80 - DNA, 692 bp, Artificial Sequence
  Description of Artificial Sequence: Synthetic nucleotide construct
  CDS (26)..(643)
ctgcaggcgctctagaggatccgcaatgggaaaaatggcttctctatttgccacatttttagtggttttagtgtcacttagcttagcatcaccctctccaagcccttccccatcgccttgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatcaccctctccaagcccttccccatcgccttgactgtacaagtaaagcagcggccgccaccgcggaggagctcgaatcg

SEQ ID NO: 81 - protein, 206 aa, Artificial Sequence
  Description of Artificial Sequence: Synthetic amino acid construct
MGKMASLFATFLVVLVSLSLASPSPSPSPSPCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESPSPSPSPSP

SEQ ID NO: 82 - DNA, 662 bp, Artificial Sequence
  Description of Artificial Sequence: Synthetic nucleotide construct
  CDS (26)..(613)
ctgcaggcgctctagaggatccgcaatgggaaaaatggcttctctatttgccacatttttagtggttttagtgtcacttagcttagcatcaccctctccaagcccttccccatcgccttgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgactgtacaagtaaagcagcggccgccaccgcggaggagctcgaatcg

SEQ ID NO: 83 - protein, 196 aa, Artificial Sequence
  Description of Artificial Sequence: Synthetic amino acid construct
MGKMASLFATFLVVLVSLSLASPSPSPSPSPCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 84 - DNA, 751 bp, Artificial Sequence
  Description of Artificial Sequence: Synthetic nucleotide construct
  CDS (13)..(705)
agaggatccgcaatgggaaaaatggcttctctatttgccacatttttagtggttttagtgtcacttagcttagcacaaacaacccgggcctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatcaccctctccaagcccttccccatcgcctagtccctcaccatccccttctcccagcccatcaccctctccaagcccttccccatcgcctagtccctcaccatccccttctcccagcccatagctgtacaagtaaagcggccgccaccgcggaggagctcgaatcg

SEQ ID NO: 85 - protein, 231 aa, Artificial Sequence
  Description of Artificial Sequence: Synthetic amino acid construct
MGKMASLFATFLVVLVSLSLAQTTRACDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESPSPSPSPSPSPSPSPSPSPSPSPSPSPSPSPSPSPSPSP

SEQ ID NO: 86 - DNA, 752 bp, Artificial Sequence
  Description of Artificial Sequence: Synthetic nucleotide construct
  CDS (26)..(703)
ctgcaggcgctctagaggatccgcaatgggaaaaatggcttctctatttgccacatttttagtggttttagtgtcacttagcttagcatcaccctctccaagcccttccccatcgcctagtccctcaccatccccttctcccagcccatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatcaccctctccaagcccttccccatcgcctagtccctcaccatccccttctcccagcccatagctgtacaagtaaagcagcggccgccaccgcggaggagctcgaatcg

SEQ ID NO: 87 - protein, 226 aa, Artificial Sequence
  Description of Artificial Sequence: Synthetic amino acid construct
MGKMASLFATFLVVLVSLSLASPSPSPSPSPSPSPSPSPSPCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESPSPSPSPSPSPSPSPSPSP

SEQ ID NO: 88 - DNA, 1259 bp, Artificial Sequence
  Description of Artificial Sequence: Synthetic nucleotide construct
  CDS (27)..(1259)
ctgacagaggatccgcaatgggaaaaatggcttctctatttgccacatttttagtggttttagtgtcacttagcttagcacaaacaacccggagtgccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggggtaccgggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccggccctcatagcccacctccaccattatcaccatcacctactccaactcctcctttgggaccacacagtccaccccctacactttccccttcaccaaccccaacaccacctcccgtcaccatggtg

SEQ ID NO: 89 - protein, 411 aa, Artificial Sequence
  Description of Artificial Sequence: Synthetic amino acid construct
MASLFATFLVVLVSLSLAQTTRSAGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGVPGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPGPHSPPPPLSPSPTPTPPLGPHSPPPTLSPSPTPTPPPVTMV

SEQ ID NO: 90 - protein, 4 aa, Artificial Sequence
  Description of Artificial Sequence: Synthetic peptide motif
SPSP

SEQ ID NO: 91 - DNA, 32 bp, Artificial Sequence; identical to SEQ ID NO: 37
  Description of Artificial Sequence: Synthetic primer

SEQ ID NO: 92 - protein, 10 aa, Artificial Sequence
  Description of Artificial Sequence: Synthetic peptide motif
SPSPSPSPSP

SEQ ID NO: 93 - protein, 40 aa, Artificial Sequence
  Description of Artificial Sequence: Synthetic amino acid motif
SPSPSPSPSPSPSPSPSPSPSPSPSPSPSPSPSPSPSPSP

SEQ ID NO: 94 - protein, 2000 aa, Artificial Sequence
  Description of Artificial Sequence: Synthetic amino acid motif
  VARIANT (2)..(2): Lys, Ser, Ala, Thr, Gly, or Val
  VARIANT (4)..(4): Lys, Ser, Ala, Thr, Gly, or Val
  VARIANT (6)..(6): Lys, Ser, Ala, Thr, Gly, or Val
  VARIANT (8)..(8): Lys, Ser, Ala, Thr, Gly, or Val
  VARIANT (10)..(10): Lys, Ser, Ala, Thr, Gly, or Val
  VARIANT (12)..(12): Lys, Ser, Ala, Thr, Gly, or Val
  VARIANT (14)..(14): Lys, Ser, Ala, Thr, Gly, or Val
  VARIANT (16)..(16): Lys, Ser, Ala, Thr, Gly, or Val
  VARIANT (18)..(18): Lys, Ser, Ala, Thr, Gly, or Val
  VARIANT (20)..(20): Lys, Ser, Ala, Thr, Gly, or Val
  VARIANT (22)..(22): Lys, Ser, Ala, Thr, Gly, or Val
  VARIANT (24)..(24): Lys, Ser, Ala, Thr, Gly, or Val
  VARIANT (26)..(26): Lys, Ser, Ala, Thr, Gly, or Val
  VARIANT (28)..(28): Lys, Ser, Ala, Thr, Gly, or Val
  VARIANT (30)..(30): Lys, Ser, Ala, Thr, Gly, or Val
  VARIANT (32)..(32): Lys, Ser, Ala, Thr, Gly, or Val
  VARIANT (34)..(34): Lys, Ser, Ala, Thr, Gly, or Val
  VARIANT (36)..(36): Lys, Ser, Ala, Thr, Gly, or Val
  VARIANT (38)..(38): Lys, Ser, Ala, Thr, Gly, or Val
  VARIANT (40)..(40): Lys, Ser, Ala, Thr, Gly, or Val
  VARIANT (42)..(42): Lys, Ser, Ala, Thr, Gly, or Val
  VARIANT (44)..(44): Lys, Ser, Ala, Thr, Gly, or Val
  VARIANT (46)..(46): Lys, Ser, Ala, Thr, Gly, or Val
  VARIANT (48)..(48): Lys, Ser, Ala, Thr, Gly, or Val
  VARIANT (50)..(50): Lys, Ser, Ala, Thr, Gly, or Val
  VARIANT (52)..(52): Lys, Ser, Ala, Thr, Gly, or Val
  VARIANT (54)..(54): Lys, Ser, Ala, Thr, Gly, or Val
  VARIANT (56)..(56): Lys, Ser, Ala, Thr, Gly, or Val
  VARIANT (58)..(58): Lys, Ser, Ala, Thr, Gly, or Val
  VARIANT (60)..(60): Lys, Ser, Ala, Thr, Gly, or Val
  VARIANT (62)..(62): Lys, Ser, Ala, Thr, Gly, or Val
  VARIANT (64)..(64): Lys, Ser, Ala, Thr, Gly, or Val
  VARIANT (66)..(66): Lys, Ser, Ala, Thr, Gly, or Val
  VARIANT (68)..(68): Lys, Ser, Ala, Thr, Gly, or Val
  VARIANT (70)..(70): Lys, Ser, Ala, Thr, Gly, or Val
  VARIANT (72)..(72): Lys, Ser, Ala, Thr, Gly, or Val
  VARIANT (74)..(74): Lys, Ser, Ala, Thr, Gly, or Val
  VARIANT (76)..(76): Lys, Ser, Ala, Thr, Gly, or Val
  VARIANT (78)..(78): Lys, Ser, Ala, Thr, Gly, or Val
  VARIANT (80)..(80): Lys, Ser, Ala, Thr, Gly, or Val
  VARIANT (82)..(82): Lys, Ser, Ala, Thr, Gly, or Val
  VARIANT (84)..(84): Lys, Ser, Ala, Thr, Gly, or Val
  VARIANT (86)..(86): Lys, Ser, Ala, Thr, Gly, or Val
  VARIANT (88)..(88): Lys, Ser, Ala, Thr, Gly, or Val
  VARIANT (90)..(90): Lys, Ser, Ala, Thr, Gly, or Val
  VARIANT (92)..(92): Lys, Ser, Ala, Thr, Gly, or Val
  VARIANT (94)..(94): Lys, Ser, Ala, Thr, Gly, or Val
  VARIANT (96)..(96): Lys, Ser, Ala, Thr, Gly, or Val
  VARIANT (98)..(98): Lys, Ser, Ala, Thr, Gly, or Val
  VARIANT (100)..(100): Lys, Ser, Ala, Thr, Gly, or Val
  VARIANT (102)..(102): Lys, Ser, Ala, Thr, Gly, or Val
  VARIANT (104)..(104): Lys, Ser, Ala, Thr, Gly, or Val
  VARIANT (106)..(106): Lys, Ser, Ala, Thr, Gly, or Val
  VARIANT (108)..(108): Lys, Ser, Ala, Thr, Gly, or Val
  VARIANT (110)..(110): Lys, Ser, Ala, Thr, Gly, or Val
  VARIANT (112)..(112): Lys, Ser, Ala, Thr, Gly, or Val
  VARIANT (114)..(114): Lys, Ser, Ala, Thr, Gly, or Val
  VARIANT (116)..(116): Lys, Ser, Ala, Thr, Gly, or Val
  VARIANT (118)..(118): Lys, Ser, Ala, Thr, Gly, or Val
  VARIANT (120)..(120): Lys, Ser, Ala, Thr, Gly, or Val
  VARIANT (122)..(122): Lys, Ser, Ala, Thr, Gly, or Val
  VARIANT (124)..(124): Lys, Ser, Ala, Thr, Gly, or Val
  VARIANT (126)..(126): Lys, Ser, Ala, Thr, Gly, or Val
  VARIANT (128)..(128): Lys, Ser, Ala, Thr, Gly, or Val
  VARIANT (130)..(130): Lys, Ser, Ala, Thr, Gly, or Val
  VARIANT (132)..(132): Lys, Ser, Ala, Thr, Gly, or Val
  VARIANT (134)..(134): Lys, Ser, Ala, Thr, Gly, or Val
  VARIANT (136)..(136): Lys, Ser, Ala, Thr, Gly, or Val
  VARIANT (138)..(138): Lys, Ser, Ala, Thr, Gly, or Val
  VARIANT (140)..(140): Lys, Ser, Ala, Thr, Gly, or Val
  VARIANT (142)..(142): Lys, Ser, Ala, Thr, Gly, or Val
  VARIANT (144)..(144): Lys, Ser, Ala, Thr, Gly, or Val
  VARIANT (146)..(146): Lys, Ser, Ala, Thr, Gly, or Val
  VARIANT (148)..(148): Lys, Ser, Ala, Thr, Gly, or Val
  VARIANT (150)..(150): Lys, Ser, Ala, Thr, Gly, or Val
  VARIANT (152)..(152): Lys, Ser, Ala, Thr, Gly, or Val
  VARIANT (154)..(154): Lys, Ser, Ala, Thr, Gly, or Val
  VARIANT (156)..(156): Lys, Ser, Ala, Thr, Gly, or Val
  VARIANT (158)..(158): Lys, Ser, Ala, Thr, Gly, or Val
  VARIANT (160)..(160): Lys, Ser, Ala, Thr, Gly, or Val
  VARIANT (162)..(162): Lys, Ser, Ala, Thr, Gly, or Val
  VARIANT (164)..(164): Lys, Ser, Ala, Thr, Gly, or Val
  VARIANT (166)..(166): Lys, Ser, Ala, Thr, Gly, or Val
  VARIANT (168)..(168): Lys, Ser, Ala, Thr, Gly, or Val
  VARIANT (170)..(170): Lys, Ser, Ala, Thr, Gly, or Val
  VARIANT (172)..(172): Lys, Ser, Ala, Thr, Gly, or Val
  VARIANT (174)..(174): Lys, Ser, Ala, Thr, Gly, or Val
  VARIANT (176)..(176): Lys, Ser, Ala, Thr, Gly, or Val
  VARIANT (178)..(178): Lys, Ser, Ala, Thr, Gly, or Val
  VARIANT (180)..(180): Lys, Ser, Ala, Thr, Gly, or Val
  VARIANT (182)..(182): Lys, Ser, Ala, Thr, Gly, or Val
  VARIANT (184)..(184): Lys, Ser, Ala, Thr, Gly, or Val
  VARIANT (186)..(186): Lys, Ser, Ala, Thr, Gly, or Val
  VARIANT (188)..(188): Lys, Ser, Ala, Thr, Gly, or Val
  VARIANT (190)..(190): Lys, Ser, Ala, Thr, Gly, or Val
  VARIANT (192)..(192): Lys, Ser, Ala, Thr, Gly, or Val
  VARIANT (194)..(194): Lys, Ser, Ala, Thr, Gly, or Val
  VARIANT (196)..(196): Lys, Ser, Ala, Thr, Gly, or Val
  VARIANT (198)..(198): Lys, Ser, Ala, Thr, Gly, or Val
  VARIANT (200)..(200): Lys, Ser, Ala, Thr, Gly, or Val
  VARIANT (202)..(202): Lys, Ser, Ala, Thr, Gly, or Val
  VARIANT (204)..(204): Lys, Ser, Ala, Thr, Gly, or Val
  VARIANT (206)..(206): Lys, Ser, Ala, Thr, Gly, or Val
  VARIANT (208)..(208): Lys, Ser, Ala, Thr, Gly, or Val
  VARIANT (210)..(210): Lys, Ser, Ala, Thr, Gly, or Val
  VARIANT (212)..(212): Lys, Ser, Ala, Thr, Gly, or Val
  VARIANT (214)..(214): Lys, Ser, Ala, Thr, Gly, or Val
  VARIANT (216)..(216): Lys, Ser, Ala, Thr, Gly, or Val
  VARIANT (218)..(218): Lys, Ser, Ala, Thr, Gly, or Val
  VARIANT (220)..(220): Lys, Ser, Ala, Thr, Gly, or Val
  VARIANT (222)..(222): Lys, Ser, Ala, Thr, Gly, or Val
  VARIANT (224)..(224): Lys, Ser, Ala, Thr, Gly, or Val
  VARIANT (226)..(226): Lys, Ser, Ala, Thr, Gly, or Val
  VARIANT (228)..(228): Lys, Ser, Ala, Thr, Gly, or Val
  VARIANT (230)..(230): Lys, Ser, Ala, Thr, Gly, or Val
  VARIANT (232)..(232): Lys, Ser, Ala, Thr, Gly, or Val
  VARIANT (234)..(234): Lys, Ser, Ala, Thr, Gly, or Val
  VARIANT (236)..(236): Lys, Ser, Ala, Thr, Gly, or Val
  VARIANT (238)..(238): Lys, Ser, Ala, Thr, Gly, or Val
  VARIANT (240)..(240): Lys, Ser, Ala, Thr, Gly, or Val
  VARIANT (242)..(242): Lys, Ser, Ala, Thr, Gly, or Val
  VARIANT (244)..(244): Lys, Ser, Ala, Thr, Gly, or Val
  VARIANT (246)..(246): Lys, Ser, Ala, Thr, Gly, or Val
  VARIANT (248)..(248): Lys, Ser, Ala, Thr, Gly, or Val
  VARIANT (250)..(250): Lys, Ser, Ala, Thr, Gly, or Val
  VARIANT (252)..(252): Lys, Ser, Ala, Thr, Gly, or Val
  VARIANT (254)..(254): Lys, Ser, Ala, Thr, Gly, or Val
  VARIANT (256)..(256): Lys, Ser, Ala, Thr, Gly, or Val
  VARIANT (258)..(258): Lys, Ser, Ala, Thr, Gly, or Val
  VARIANT (260)..(260): Lys, Ser, Ala, Thr, Gly, or Val
  VARIANT (262)..(262): Lys, Ser, Ala, Thr, Gly, or Val
  VARIANT (264)..(264): Lys, Ser, Ala, Thr, Gly, or Val
  VARIANT (266)..(266): Lys, Ser, Ala, Thr, Gly, or Val
  VARIANT (268)..(268): Lys, Ser, Ala, Thr, Gly, or Val
  VARIANT (270)..(270): Lys, Ser, Ala, Thr, Gly, or Val
  VARIANT (272)..(272): Lys, Ser, Ala, Thr, Gly, or Val
  VARIANT (274)..(274): Lys, Ser, Ala, Thr, Gly, or Val
  VARIANT (276)..(276): Lys, Ser, Ala, Thr, Gly, or Val
  VARIANT (278)..(278): Lys, Ser, Ala, Thr, Gly, or Val
  VARIANT (280)..(280): Lys, Ser, Ala, Thr, Gly, or Val
  VARIANT (282)..(282): Lys, Ser, Ala, Thr, Gly, or Val
  VARIANT (284)..(284): Lys, Ser, Ala, Thr, Gly, or Val
  VARIANT (286)..(286): Lys, Ser, Ala, Thr, Gly, or Val
  VARIANT (288)..(288): Lys, Ser, Ala, Thr, Gly, or Val
  VARIANT (290)..(290): Lys, Ser, Ala, Thr, Gly, or Val
  VARIANT (292)..(292): Lys, Ser, Ala, Thr, Gly, or Val
  VARIANT (294)..(294): Lys, Ser, Ala, Thr, Gly, or Val
  VARIANT (296)..(296): Lys, Ser, Ala, Thr, Gly, or Val
  VARIANT (298)..(298): Lys, Ser, Ala, Thr, Gly, or Val
  VARIANT (300)..(300): Lys, Ser, Ala, Thr, Gly, or Val
  VARIANT (302)..(302): Lys, Ser, Ala, Thr, Gly, or Val
  VARIANT (304)..(304): Lys, Ser, Ala, Thr, Gly, or Val
  VARIANT (306)..(306): Lys, Ser, Ala, Thr, Gly, or Val
  VARIANT (308)..(308): Lys, Ser, Ala, Thr, Gly, or Val
  VARIANT (310)..(310): Lys, Ser, Ala, Thr, Gly, or Val
  VARIANT (312)..(312): Lys, Ser, Ala, Thr, Gly, or Val
  VARIANT (314)..(314): Lys, Ser, Ala, Thr, Gly, or Val
  VARIANT (316)..(316): Lys, Ser, Ala, Thr, Gly, or Val
  VARIANT (318)..(318): Lys, Ser, Ala, Thr, Gly, or Val
  VARIANT (320)..(320): Lys, Ser, Ala, Thr, Gly, or Val
  VARIANT (322)..(322): Lys, Ser, Ala, Thr, Gly, or Val
  VARIANT (324)..(324): Lys, Ser, Ala, Thr, Gly, or Val
  VARIANT (326)..(326): Lys, Ser, Ala, Thr, Gly, or Val
  VARIANT (328)..(328): Lys, Ser, Ala, Thr, Gly, or Val
  VARIANT (330)..(330): Lys, Ser, Ala, Thr, Gly, or Val
  VARIANT (332)..(332): Lys, Ser, Ala, Thr, Gly, or Val
  VARIANT (334)..(334): Lys, Ser, Ala, Thr, Gly, or Val
  VARIANT (336)..(336): Lys, Ser, Ala, Thr, Gly, or Val
  VARIANT (338)..(338): Lys, Ser, Ala, Thr, Gly, or Val
  VARIANT (340)..(340): Lys, Ser, Ala, Thr, Gly, or Val
  VARIANT (342)..(342): Lys, Ser, Ala, Thr, Gly, or Val
  VARIANT (344)..(344): Lys, Ser, Ala, Thr, Gly, or Val
  VARIANT (346)..(346): Lys, Ser, Ala, Thr, Gly, or Val
  VARIANT (348)..(348): Lys, Ser, Ala, Thr, Gly, or Val
  VARIANT (350)..(350): Lys, Ser, Ala, Thr, Gly, or Val
  VARIANT (352)..(352): Lys, Ser, Ala, Thr, Gly, or Val
  VARIANT (354)..(354): Lys, Ser, Ala, Thr, Gly, or Val
  VARIANT (356)..(356): Lys, Ser, Ala, Thr, Gly, or Val
  VARIANT (358)..(358): Lys, Ser, Ala, Thr, Gly, or Val
  VARIANT (360)..(360): Lys, Ser, Ala, Thr, Gly, or Val
  VARIANT (362)..(362): Lys, Ser, Ala, Thr, Gly, or Val
  VARIANT (364)..(364): Lys, Ser, Ala, Thr, Gly, or Val
  VARIANT (366)..(366): Lys, Ser, Ala, Thr, Gly, or Val
  VARIANT (368)..(368): Lys, Ser, Ala, Thr, Gly, or Val
  VARIANT (370)..(370): Lys, Ser, Ala, Thr, Gly, or Val
  VARIANT (372)..(372): Lys, Ser, Ala, Thr, Gly, or Val
  VARIANT (374)..(374): Lys, Ser, Ala, Thr, Gly, or Val
  VARIANT (376)..(376): Lys, Ser, Ala, Thr, Gly, or Val
  VARIANT (378)..(378): Lys, Ser, Ala, Thr, Gly, or Val
  VARIANT (380)..(380): Lys, Ser, Ala, Thr, Gly, or Val
  VARIANT (382)..(382): Lys, Ser, Ala, Thr, Gly, or Val
  VARIANT (384)..(384): Lys, Ser, Ala, Thr, Gly, or Val
  VARIANT (386)..(386): Lys, Ser, Ala, Thr, Gly, or Val
  VARIANT (388)..(388): Lys, Ser, Ala, Thr, Gly, or Val
  VARIANT (390)..(390): Lys, Ser, Ala, Thr, Gly, or Val
  VARIANT (392)..(392): Lys, Ser, Ala, Thr, Gly, or Val
  VARIANT (394)..(394): Lys, Ser, Ala, Thr, Gly, or Val
  VARIANT (396)..(396): Lys, Ser, Ala, Thr, Gly, or Val
  VARIANT (398)..(398): Lys, Ser, Ala, Thr, Gly, or Val
  VARIANT (400)..(400): Lys, Ser, Ala, Thr, Gly, or Val
  VARIANT (402)..(402): Lys, Ser, Ala, Thr, Gly, or Val
  VARIANT (404)..(404): Lys, Ser, Ala, Thr, Gly, or Val
  VARIANT (406)..(406): Lys, Ser, Ala, Thr, Gly, or Val
  VARIANT (408)..(408): Lys, Ser, Ala, Thr, Gly, or Val
  VARIANT (410)..(410): Lys, Ser, Ala, Thr, Gly, or Val
  VARIANT (412)..(412): Lys, Ser, Ala, Thr, Gly, or Val
  VARIANT (414)..(414): Lys, Ser, Ala, Thr, Gly, or Val
  VARIANT (416)..(416): Lys, Ser, Ala, Thr, Gly, or Val
  VARIANT (418)..(418): Lys, Ser, Ala, Thr, Gly, or Val
  VARIANT (420)..(420): Lys, Ser, Ala, Thr, Gly, or Val
  VARIANT (422)..(422): Lys, Ser, Ala, Thr, Gly, or Val
  VARIANT (424)..(424): Lys, Ser, Ala, Thr, Gly, or Val
  VARIANT (426)..(426): Lys, Ser, Ala, Thr, Gly, or Val
  VARIANT (428)..(428): Lys, Ser, Ala, Thr, Gly, or Val
  VARIANT (430)..(430): Lys, Ser, Ala, Thr, Gly, or Val
  VARIANT (432)..(432): Lys, Ser, Ala, Thr, Gly, or Val
  VARIANT (434)..(434): Lys, Ser, Ala, Thr, Gly, or Val
  VARIANT (436)..(436): Lys, Ser, Ala, Thr, Gly, or Val
  VARIANT (438)..(438): Lys, Ser, Ala, Thr, Gly, or Val
  VARIANT (440)..(440): Lys, Ser, Ala, Thr, Gly, or Val
  VARIANT (442)..(442): Lys, Ser, Ala, Thr, Gly, or Val
  VARIANT (444)..(444): Lys, Ser, Ala, Thr, Gly, or Val
  VARIANT (446)..(446): Lys, Ser, Ala, Thr, Gly, or Val
  VARIANT (448)..(448): Lys, Ser, Ala, Thr, Gly, or Val
  VARIANT (450)..(450): Lys, Ser, Ala, Thr, Gly, or Val
  VARIANT (452)..(452): Lys, Ser, Ala, Thr, Gly, or Val
  VARIANT (454)..(454): Lys, Ser, Ala, Thr, Gly, or Val
  VARIANT (456)..(456): Lys, Ser, Ala, Thr, Gly, or Val
  VARIANT (458)..(458): Lys, Ser, Ala, Thr, Gly, or Val
  VARIANT (460)..(460): Lys, Ser, Ala, Thr, Gly, or Val
  VARIANT (462)..(462): Lys, Ser, Ala, Thr, Gly, or Val
  VARIANT (464)..(464): Lys, Ser, Ala, Thr, Gly, or Val
  VARIANT (466)..(466): Lys, Ser, Ala, Thr, Gly, or Val
  VARIANT (468)..(468): Lys, Ser, Ala, Thr, Gly, or Val
  VARIANT (470)..(470): Lys, Ser, Ala, Thr, Gly, or Val
  VARIANT (472)..(472): Lys, Ser, Ala, Thr, Gly, or Val
  VARIANT (474)..(474): Lys, Ser, Ala, Thr, Gly, or Val
  VARIANT (476)..(476): Lys, Ser, Ala, Thr, Gly, or Val
  VARIANT (478)..(478): Lys, Ser, Ala, Thr, Gly, or Val
  VARIANT (480)..(480): Lys, Ser, Ala, Thr, Gly, or Val
  VARIANT (482)..(482): Lys, Ser, Ala, Thr, Gly, or Val
  VARIANT (484)..(484): Lys, Ser, Ala, Thr, Gly, or Val
  VARIANT (486)..(486): Lys, Ser, Ala, Thr, Gly, or Val
  VARIANT (488)..(488): Lys, Ser, Ala, Thr, Gly, or Val
  VARIANT (490)..(490): Lys, Ser, Ala, Thr, Gly, or Val
  VARIANT (492)..(492): Lys, Ser, Ala, Thr, Gly, or Val
  VARIANT (494)..(494): Lys, Ser, Ala, Thr, Gly, or Val
  VARIANT (496)..(496): Lys, Ser, Ala, Thr, Gly, or Val
  VARIANT (498)..(498): Lys, Ser, Ala, Thr, Gly, or Val
  VARIANT (500)..(500): Lys, Ser, Ala, Thr, Gly, or Val
  VARIANT (502)..(502): Lys, Ser, Ala, Thr, Gly, or Val
  VARIANT (504)..(504): Lys, Ser, Ala, Thr, Gly, or Val
  VARIANT (506)..(506): Lys, Ser, Ala, Thr, Gly, or Val
  VARIANT (508)..(508): Lys, Ser, Ala, Thr, Gly, or Val
  VARIANT (510)..(510): Lys, Ser, Ala, Thr, Gly, or Val
  VARIANT (512)..(512): Lys, Ser, Ala, Thr, Gly, or Val
  VARIANT (514)..(514): Lys, Ser, Ala, Thr, Gly, or Val
  VARIANT (516)..(516): Lys, Ser, Ala, Thr, Gly, or Val
  VARIANT (518)..(518): Lys, Ser, Ala, Thr, Gly, or Val
  VARIANT (520)..(520): Lys, Ser, Ala, Thr, Gly, or Val
  VARIANT (522)..(522): Lys, Ser, Ala, Thr, Gly, or Val
  VARIANT (524)..(524): Lys, Ser, Ala, Thr, Gly, or Val
  VARIANT (526)..(526): Lys, Ser, Ala, Thr, Gly, or Val
  VARIANT (528)..(528): Lys, Ser, Ala, Thr, Gly, or Val
  VARIANT (530)..(530): Lys, Ser, Ala, Thr, Gly, or Val
  VARIANT (532)..(532): Lys, Ser, Ala, Thr, Gly, or Val
  VARIANT (534)..(534): Lys, Ser, Ala, Thr, Gly, or Val
  VARIANT (536)..(536): Lys, Ser, Ala, Thr, Gly, or Val
  VARIANT (538)..(538): Lys, Ser, Ala, Thr, Gly, or Val
  VARIANT (540)..(540): Lys, Ser, Ala, Thr, Gly, or Val
  VARIANT (542)..(542): Lys, Ser, Ala, Thr, Gly, or Val
  VARIANT (544)..(544): Lys, Ser, Ala, Thr, Gly, or Val
  VARIANT (546)..(546): Lys, Ser, Ala, Thr, Gly, or Val
  VARIANT (548)..(548): Lys, Ser, Ala, Thr, Gly, or Val
  VARIANT (550)..(550): Lys, Ser, Ala, Thr, Gly, or Val
  VARIANT (552)..(552): Lys, Ser, Ala, Thr, Gly, or Val
  VARIANT (554)..(554): Lys, Ser, Ala, Thr, Gly, or Val
  VARIANT (556)..(556): Lys, Ser, Ala, Thr, Gly, or Val
  VARIANT (558)..(558): Lys, Ser, Ala, Thr, Gly, or Val
  VARIANT (560)..(560): Lys, Ser, Ala, Thr, Gly, or Val
  VARIANT (562)..(562): Lys, Ser, Ala, Thr, Gly, or Val
  VARIANT (564)..(564): Lys, Ser, Ala, Thr, Gly, or Val
  VARIANT (566)..(566): Lys, Ser, Ala, Thr, Gly, or Val
  VARIANT (568)..(568): Lys, Ser, Ala, Thr, Gly, or Val
  VARIANT (570)..(570): Lys, Ser, Ala, Thr, Gly, or Val
  VARIANT (572)..(572): Lys, Ser, Ala, Thr, Gly, or Val
  VARIANT (574)..(574): Lys, Ser, Ala, Thr, Gly, or Val
  VARIANT (576)..(576): Lys, Ser, Ala, Thr, Gly, or Val
  VARIANT (578)..(578): Lys, Ser, Ala, Thr, Gly, or Val
  VARIANT (580)..(580): Lys, Ser, Ala, Thr, Gly, or Val
  VARIANT (582)..(582): Lys, Ser, Ala, Thr, Gly, or Val
  VARIANT (584)..(584): Lys, Ser, Ala, Thr, Gly, or Val
  VARIANT (586)..(586): Lys, Ser, Ala, Thr, Gly, or Val
  VARIANT (588)..(588): Lys, Ser, Ala, Thr, Gly, or Val
  VARIANT (590)..(590): Lys, Ser, Ala, Thr, Gly, or Val
  VARIANT (592)..(592): Lys, Ser, Ala, Thr, Gly, or Val
  VARIANT (594)..(594): Lys, Ser, Ala, Thr, Gly, or Val
  VARIANT (596)..(596): Lys, Ser, Ala, Thr, Gly, or Val
  VARIANT (598)..(598): Lys, Ser, Ala, Thr, Gly, or Val
  VARIANT (600)..(600): Lys, Ser, Ala, Thr, Gly, or Val
  VARIANT (602)..(602): Lys, Ser, Ala, Thr, Gly, or Val
  VARIANT (604)..(604): Lys, Ser, Ala, Thr, Gly, or Val
  VARIANT (606)..(606): Lys, Ser, Ala, Thr, Gly, or Val
  VARIANT (608)..(608): Lys, Ser, Ala, Thr, Gly, or Val
  VARIANT (610)..(610): Lys, Ser, Ala, Thr, Gly, or Val
  VARIANT (612)..(612): Lys, Ser, Ala, Thr, Gly, or Val
  VARIANT (614)..(614): Lys, Ser, Ala, Thr, Gly, or Val
  VARIANT (616)..(616): Lys, Ser, Ala, Thr, Gly, or Val
  VARIANT (618)..(618): Lys, Ser, Ala, Thr, Gly, or Val
  VARIANT (620)..(620): Lys, Ser, Ala, Thr, Gly, or Val
  VARIANT (622)..(622): Lys, Ser, Ala, Thr, Gly, or Val
  VARIANT (624)..(624): Lys, Ser, Ala, Thr, Gly, or Val
  VARIANT (626)..(626): Lys, Ser, Ala, Thr, Gly, or Val
  VARIANT (628)..(628): Lys, Ser, Ala, Thr, Gly, or Val
  VARIANT (630)..(630): Lys, Ser, Ala, Thr, Gly, or Val
  VARIANT (632)..(632): Lys, Ser, Ala, Thr, Gly, or Val
  VARIANT (634)..(634): Lys, Ser, Ala, Thr, Gly, or Val
  VARIANT (636)..(636): Lys, Ser, Ala, Thr, Gly, or Val
  VARIANT (638)..(638): Lys, Ser, Ala, Thr, Gly, or Val
  VARIANT (640)..(640): Lys, Ser, Ala, Thr, Gly, or Val
  VARIANT (642)..(642): Lys, Ser, Ala, Thr, Gly, or Val
  VARIANT (644)..(644): Lys, Ser, Ala, Thr, Gly, or Val
  VARIANT (646)..(646): Lys, Ser, Ala, Thr, Gly, or Val
  VARIANT (648)..(648): Lys, Ser, Ala, Thr, Gly, or Val
  VARIANT (650)..(650): Lys, Ser, Ala, Thr, Gly, or Val
  VARIANT (652)..(652): Lys, Ser, Ala, Thr, Gly, or Val
  VARIANT (654)..(654): Lys, Ser, Ala, Thr, Gly, or Val
  VARIANT (656)..(656): Lys, Ser, Ala, Thr, Gly, or Val
  VARIANT (658)..(658): Lys, Ser, Ala, Thr, Gly, or Val
  VARIANT (660)..(660): Lys, Ser, Ala, Thr, Gly, or Val
  VARIANT (662)..(662): Lys, Ser, Ala, Thr, Gly, or Val
  VARIANT (664)..(664): Lys, Ser, Ala, Thr, Gly, or Val
  VARIANT (666)..(666): Lys, Ser, Ala, Thr, Gly, or Val
  VARIANT (668)..(668): Lys, Ser, Ala, Thr, Gly, or Val
  VARIANT (670)..(670): Lys, Ser, Ala, Thr, Gly, or Val
  VARIANT (672)..(672): Lys, Ser, Ala, Thr, Gly, or Val
  VARIANT (674)..(674): Lys, Ser, Ala, Thr, Gly, or Val
  VARIANT (676)..(676): Lys, Ser, Ala, Thr, Gly, or Val
  VARIANT (678)..(678): Lys, Ser, Ala, Thr, Gly, or Val
  VARIANT (680)..(680): Lys, Ser, Ala, Thr, Gly, or Val
  VARIANT (682)..(682): Lys, Ser, Ala, Thr, Gly, or Val
  VARIANT (684)..(684): Lys, Ser, Ala, Thr, Gly, or Val
  VARIANT (686)..(686): Lys, Ser, Ala, Thr, Gly, or Val
  VARIANT (688)..(688): Lys, Ser, Ala, Thr, Gly, or Val
  VARIANT (690)..(690): Lys, Ser, Ala, Thr, Gly, or Val
  VARIANT (692)..(692): Lys, Ser, Ala, Thr, Gly, or Val
  VARIANT (694)..(694): Lys, Ser, Ala, Thr, Gly, or Val
  VARIANT (696)..(696): Lys, Ser, Ala, Thr, Gly, or Val
  VARIANT (698)..(698): Lys, Ser, Ala, Thr, Gly, or Val
  VARIANT (700)..(700): Lys, Ser, Ala, Thr, Gly, or Val
  VARIANT (702)..(702): Lys, Ser, Ala, Thr, Gly, or Val
  VARIANT (704)..(704): Lys, Ser, Ala, Thr, Gly, or Val
  VARIANT (706)..(706): Lys, Ser, Ala, Thr, Gly, or Val
  VARIANT (708)..(708): Lys, Ser, Ala, Thr, Gly, or Val
  VARIANT (710)..(710): Lys, Ser, Ala, Thr, Gly, or Val
  VARIANT (712)..(712): Lys, Ser, Ala, Thr, Gly, or Val
  VARIANT (714)..(714): Lys, Ser, Ala, Thr, Gly, or Val
  VARIANT (716)..(716): Lys, Ser, Ala, Thr, Gly, or Val
  VARIANT (718)..(718): Lys, Ser, Ala, Thr, Gly, or Val
  VARIANT (720)..(720): Lys, Ser, Ala, Thr, Gly, or Val
  VARIANT (722)..(722): Lys, Ser, Ala, Thr, Gly, or Val
  VARIANT (724)..(724): Lys, Ser, Ala, Thr, Gly, or Val
  VARIANT (726)..(726): Lys, Ser, Ala, Thr, Gly, or Val
  VARIANT (728)..(728): Lys, Ser, Ala, Thr, Gly, or Val
  VARIANT (730)..(730): Lys, Ser, Ala, Thr, Gly, or Val
  VARIANT (732)..(732): Lys, Ser, Ala, Thr, Gly, or Val
  VARIANT (734)..(734): Lys, Ser, Ala, Thr, Gly, or Val
  VARIANT (736)..(736): Lys, Ser, Ala, Thr, Gly, or Val
  VARIANT (738)..(738): Lys, Ser, Ala, Thr, Gly, or Val
  VARIANT (740)..(740): Lys, Ser, Ala, Thr, Gly, or Val
  VARIANT (742)..(742): Lys, Ser, Ala, Thr, Gly, or Val
  VARIANT (744)..(744): Lys, Ser, Ala, Thr, Gly, or Val
  VARIANT (746)..(746): Lys, Ser, Ala, Thr, Gly, or Val
  VARIANT (748)..(748): Lys, Ser, Ala, Thr, Gly, or Val
  VARIANT (750)..(750): Lys, Ser, Ala, Thr, Gly, or Val
  VARIANT (752)..(752): Lys, Ser, Ala, Thr, Gly, or Val
  VARIANT (754)..(754): Lys, Ser, Ala, Thr, Gly, or Val
  VARIANT (756)..(756): Lys, Ser, Ala, Thr, Gly, or Val
  VARIANT (758)..(758): Lys, Ser, Ala, Thr, Gly, or Val
  VARIANT (760)..(760): Lys, Ser, Ala, Thr, Gly, or Val
  VARIANT (762)..(762): Lys, Ser, Ala, Thr, Gly, or Val
  VARIANT (764)..(764): Lys, Ser, Ala, Thr, Gly, or Val
  VARIANT (766)..(766): Lys, Ser, Ala, Thr, Gly, or Val
  VARIANT (768)..(768): Lys, Ser, Ala, Thr, Gly, or Val
  VARIANT (770)..(770): Lys, Ser, Ala, Thr, Gly, or Val
  VARIANT (772)..(772): Lys, Ser, Ala, Thr, Gly, or Val
  VARIANT (774)..(774): Lys, Ser, Ala, Thr, Gly, or Val
  VARIANT (776)..(776): Lys, Ser, Ala, Thr, Gly, or Val
  VARIANT (778)..(778): Lys, Ser, Ala, Thr, Gly, or Val
  VARIANT (780)..(780): Lys, Ser, Ala, Thr, Gly, or Val
  VARIANT (782)..(782): Lys, Ser, Ala, Thr, Gly, or Val
  VARIANT (784)..(784): Lys, Ser, Ala, Thr, Gly, or Val
  VARIANT (786)..(786): Lys, Ser, Ala, Thr, Gly, or Val
  VARIANT (788)..(788): Lys, Ser, Ala, Thr, Gly, or Val
  VARIANT (790)..(790): Lys, Ser, Ala, Thr, Gly, or Val
  VARIANT (792)..(792): Lys, Ser, Ala, Thr, Gly, or Val
  VARIANT (794)..(794): Lys, Ser, Ala, Thr, Gly, or Val
  VARIANT (796)..(796): Lys, Ser, Ala, Thr, Gly, or Val
  VARIANT (798)..(798): Lys, Ser, Ala, Thr, Gly, or Val
  VARIANT (800)..(800): Lys, Ser, Ala, Thr, Gly, or Val
  VARIANT (802)..(802): Lys, Ser, Ala, Thr, Gly, or Val
  VARIANT (804)..(804): Lys, Ser, Ala, Thr, Gly, or Val
  VARIANT (806)..(806): Lys, Ser, Ala, Thr, Gly, or Val
  VARIANT (808)..(808): Lys, Ser, Ala, Thr, Gly, or Val
  VARIANT (810)..(810): Lys, Ser, Ala, Thr, Gly, or Val
  VARIANT (812)..(812): Lys, Ser, Ala, Thr, Gly, or Val
  VARIANT (814)..(814): Lys, Ser, Ala, Thr, Gly, or Val
  VARIANT (816)..(816): Lys, Ser, Ala, Thr, Gly, or Val
  VARIANT (818)..(818): Lys, Ser, Ala, Thr, Gly, or Val
  VARIANT (820)..(820): Lys, Ser, Ala, Thr, Gly, or Val
  VARIANT (822)..(822): Lys, Ser, Ala, Thr, Gly, or Val
  VARIANT (824)..(824): Lys, Ser, Ala, Thr, Gly, or Val
  VARIANT (826)..(826): Lys, Ser, Ala, Thr, Gly, or Val
  VARIANT (828)..(828): Lys, Ser, Ala, Thr, Gly, or Val
  VARIANT (830)..(830): Lys, Ser, Ala, Thr, Gly, or Val
  VARIANT (832)..(832): Lys, Ser, Ala, Thr, Gly, or Val
  VARIANT (834)..(834): Lys, Ser, Ala, Thr, Gly, or Val
  VARIANT (836)..(836): Lys, Ser, Ala, Thr, Gly, or Val
  VARIANT (838)..(838): Lys, Ser, Ala, Thr, Gly, or Val
  VARIANT (840)..(840): Lys, Ser, Ala, Thr, Gly, or Val
  VARIANT (842)..(842): Lys, Ser, Ala, Thr, Gly, or Val
  VARIANT (844)..(844): Lys, Ser, Ala, Thr, Gly, or Val
  VARIANT (846)..(846): Lys, Ser, Ala, Thr, Gly, or Val
  VARIANT (848)..(848): Lys, Ser, Ala, Thr, Gly, or Val
  VARIANT (850)..(850): Lys, Ser, Ala, Thr, Gly, or Val
  VARIANT (852)..(852): Lys, Ser, Ala, Thr, Gly, or Val
  VARIANT (854)..(854): Lys, Ser, Ala, Thr, Gly, or Val
  VARIANT (856)..(856): Lys, Ser, Ala, Thr, Gly, or Val
  VARIANT (858)..(858): Lys, Ser, Ala, Thr, Gly, or Val
  VARIANT (860)..(860): Lys, Ser, Ala, Thr, Gly, or Val
  VARIANT (862)..(862): Lys, Ser, Ala, Thr, Gly, or Val
  VARIANT (864)..(864): Lys, Ser, Ala, Thr, Gly, or Val
  VARIANT (866)..(866): Lys, Ser, Ala, Thr, Gly, or Val
  VARIANT (868)..(868): Lys, Ser, Ala, Thr, Gly, or Val
  VARIANT (870)..(870): Lys, Ser, Ala, Thr, Gly, or Val
  VARIANT (872)..(872): Lys, Ser, Ala, Thr, Gly, or Val
  VARIANT (874)..(874): Lys, Ser, Ala, Thr, Gly, or Val
  VARIANT (876)..(876): Lys, Ser, Ala, Thr, Gly, or Val
  VARIANT (878)..(878): Lys, Ser, Ala, Thr, Gly, or Val
  VARIANT (880)..(880): Lys, Ser, Ala, Thr, Gly, or Val
  VARIANT (882)..(882): Lys, Ser, Ala, Thr, Gly, or Val
  VARIANT (884)..(884): Lys, Ser, Ala, Thr, Gly, or Val
  VARIANT (886)..(886): Lys, Ser, Ala, Thr, Gly, or Val
  VARIANT (888)..(888): Lys, Ser, Ala, Thr, Gly, or Val
  VARIANT (890)..(890): Lys, Ser, Ala, Thr, Gly, or Val
  VARIANT (892)..(892): Lys, Ser, Ala, Thr, Gly, or Val
  VARIANT (894)..(894): Lys, Ser, Ala, Thr, Gly, or Val
  VARIANT (896)..(896): Lys, Ser, Ala, Thr, Gly, or Val
  VARIANT (898)..(898): Lys, Ser, Ala, Thr, Gly, or Val
  VARIANT (900)..(900): Lys, Ser, Ala, Thr, Gly, or Val
  VARIANT (902)..(902): Lys, Ser, Ala, Thr, Gly, or Val
  VARIANT (904)..(904): Lys, Ser, Ala, Thr, Gly, or Val
  VARIANT (906)..(906): Lys, Ser, Ala, Thr, Gly, or Val
  VARIANT (908)..(908): Lys, Ser, Ala, Thr, Gly, or Val
  VARIANT (910)..(910): Lys, Ser, Ala, Thr, Gly, or Val
  VARIANT (912)..(912): Lys, Ser, Ala, Thr, Gly, or Val
  VARIANT (914)..(914): Lys, Ser, Ala, Thr, Gly, or Val
  VARIANT (916)..(916): Lys, Ser, Ala, Thr, Gly, or Val
  VARIANT (918)..(918): Lys, Ser, Ala, Thr, Gly, or Val
  VARIANT (920)..(920): Lys, Ser, Ala, Thr, Gly, or Val
  VARIANT (922)..(922): Lys, Ser, Ala, Thr, Gly, or Val
  VARIANT (924)..(924): Lys, Ser, Ala, Thr, Gly, or Val
  VARIANT (926)..(926): Lys, Ser, Ala, Thr, Gly, or Val
  VARIANT (928)..(928): Lys, Ser, Ala, Thr, Gly, or Val
  VARIANT (930)..(930): Lys, Ser, Ala, Thr, Gly, or Val
  VARIANT (932)..(932): Lys, Ser, Ala, Thr, Gly, or Val
  VARIANT (934)..(934): Lys, Ser, Ala, Thr, Gly, or Val
  VARIANT (936)..(936): Lys, Ser, Ala, Thr, Gly, or Val
  VARIANT (938)..(938): Lys, Ser, Ala, Thr, Gly, or Val
  VARIANT (940)..(940): Lys, Ser, Ala, Thr, Gly, or Val
  VARIANT (942)..(942): Lys, Ser, Ala, Thr, Gly, or Val
  VARIANT (944)..(944): Lys, Ser, Ala, Thr, Gly, or Val
  VARIANT (946)..(946): Lys, Ser, Ala, Thr, Gly, or Val
  VARIANT (948)..(948): Lys, Ser, Ala, Thr, Gly, or Val
  VARIANT (950)..(950): Lys, Ser, Ala, Thr, Gly, or Val
  VARIANT (952)..(952): Lys, Ser, Ala, Thr, Gly, or Val
  VARIANT (954)..(954): Lys, Ser, Ala, Thr, Gly, or Val
  VARIANT (956)..(956): Lys, Ser, Ala, Thr, Gly, or Val
  VARIANT (958)..(958): Lys, Ser, Ala, Thr, Gly, or Val
  VARIANT (960)..(960): Lys, Ser, Ala, Thr, Gly, or Val
  VARIANT (962)..(962): Lys, Ser, Ala, Thr, Gly, or Val
  VARIANT (964)..(964): Lys, Ser, Ala, Thr, Gly, or Val
  VARIANT (966)..(966): Lys, Ser, Ala, Thr, Gly, or Val
  VARIANT (968)..(968): Lys, Ser, Ala, Thr, Gly, or Val
  VARIANT (970)..(970): Lys, Ser, Ala, Thr, Gly, or Val
  VARIANT (972)..(972): Lys, Ser, Ala, Thr, Gly, or Val
  VARIANT (974)..(974): Lys, Ser, Ala, Thr, Gly, or Val
  VARIANT (976)..(976): Lys, Ser, Ala, Thr, Gly, or Val
  VARIANT (978)..(978): Lys, Ser, Ala, Thr, Gly, or Val
  VARIANT (980)..(980): Lys, Ser, Ala, Thr, Gly, or Val
  VARIANT (982)..(982): Lys, Ser, Ala, Thr, Gly, or Val
  VARIANT (984)..(984): Lys, Ser, Ala, Thr, Gly, or Val
  VARIANT (986)..(986): Lys, Ser, Ala, Thr, Gly, or Val
  VARIANT (988)..(988): Lys, Ser, Ala, Thr, Gly, or Val
  VARIANT (990)..(990): Lys, Ser, Ala, Thr, Gly, or Val
  VARIANT (992)..(992): Lys, Ser, Ala, Thr, Gly, or Val
  VARIANT (994)..(994): Lys, Ser, Ala, Thr, Gly, or Val
  VARIANT (996)..(996): Lys, Ser, Ala, Thr, Gly, or Val
  VARIANT (998)..(998): Lys, Ser, Ala, Thr, Gly, or Val
  VARIANT (1000)..(1000): Lys, Ser, Ala, Thr, Gly, or Val
  VARIANT (1002)..(1002): Lys, Ser, Ala, Thr, Gly, or Val
  VARIANT (1004)..(1004): Lys, Ser, Ala, Thr, Gly, or Val
  VARIANT (1006)..(1006): Lys, Ser, Ala, Thr, Gly, or Val
  VARIANT (1008)..(1008): Lys, Ser, Ala, Thr, Gly, or Val
  VARIANT (1010)..(1010): Lys, Ser, Ala, Thr, Gly, or Val
  VARIANT (1012)..(1012): Lys, Ser, Ala, Thr, Gly, or Val
  VARIANT (1014)..(1014): Lys, Ser, Ala, Thr, Gly, or Val
  VARIANT (1016)..(1016): Lys, Ser, Ala, Thr, Gly, or Val
  VARIANT (1018)..(1018): Lys, Ser, Ala, Thr, Gly, or Val
  VARIANT (1020)..(1020): Lys, Ser, Ala, Thr, Gly, or Val
  VARIANT (1022)..(1022): Lys, Ser, Ala, Thr, Gly, or Val
  VARIANT (1024)..(1024): Lys, Ser, Ala, Thr, Gly, or Val
  VARIANT (1026)..(1026): Lys, Ser, Ala, Thr, Gly, or Val
  VARIANT (1028)..(1028): Lys, Ser, Ala, Thr, Gly, or Val
  VARIANT (1030)..(1030): Lys, Ser, Ala, Thr, Gly, or Val
  VARIANT (1032)..(1032): Lys, Ser, Ala, Thr, Gly, or Val
  VARIANT (1034)..(1034): Lys, Ser, Ala, Thr, Gly, or Val
  VARIANT (1036)..(1036): Lys, Ser, Ala, Thr, Gly, or Val
  VARIANT (1038)..(1038): Lys, Ser, Ala, Thr, Gly, or Val
  VARIANT (1040)..(1040): Lys, Ser, Ala, Thr, Gly, or Val
  VARIANT (1042)..(1042): Lys, Ser, Ala, Thr, Gly, or Val
  VARIANT (1044)..(1044): Lys, Ser, Ala, Thr, Gly, or Val
  VARIANT (1046)..(1046): Lys, Ser, Ala, Thr, Gly, or Val
  VARIANT (1048)..(1048): Lys, Ser, Ala, Thr, Gly, or Val
  VARIANT (1050)..(1050): Lys, Ser, Ala, Thr, Gly, or Val
  VARIANT (1052)..(1052): Lys, Ser, Ala, Thr, Gly, or Val
  VARIANT (1054)..(1054): Lys, Ser, Ala, Thr, Gly, or Val
  VARIANT (1056)..(1056): Lys, Ser, Ala, Thr, Gly, or Val
  VARIANT (1058)..(1058): Lys, Ser, Ala, Thr, Gly, or Val
  VARIANT (1060)..(1060): Lys, Ser, Ala, Thr, Gly, or Val
  VARIANT (1062)..(1062): Lys, Ser, Ala, Thr, Gly, or Val
  VARIANT (1064)..(1064): Lys, Ser, Ala, Thr, Gly, or Val
  VARIANT (1066)..(1066): Lys, Ser, Ala, Thr, Gly, or Val
  VARIANT (1068)..(1068): Lys, Ser, Ala, Thr, Gly, or Val
  VARIANT (1070)..(1070): Lys, Ser, Ala, Thr, Gly, or Val
  VARIANT (1072)..(1072): Lys, Ser, Ala, Thr, Gly, or Val
  VARIANT (1074)..(1074): Lys, Ser, Ala, Thr, Gly, or Val
  VARIANT (1076)..(1076): Lys, Ser, Ala, Thr, Gly, or Val
  VARIANT (1078)..(1078): Lys, Ser, Ala, Thr, Gly, or Val
  VARIANT (1080)..(1080): Lys, Ser, Ala, Thr, Gly, or Val
  VARIANT (1082)..(1082): Lys, Ser, Ala, Thr, Gly, or Val
  VARIANT (1084)..(1084): Lys, Ser, Ala, Thr, Gly, or Val
  VARIANT (1086)..(1086): Lys, Ser, Ala, Thr, Gly, or Val
  VARIANT (1088)..(1088): Lys, Ser, Ala, Thr, Gly, or Val
  VARIANT (1090)..(1090): Lys, Ser, Ala, Thr, Gly, or Val
  VARIANT (1092)..(1092): Lys, Ser, Ala, Thr, Gly, or Val
  VARIANT (1094)..(1094): Lys, Ser, Ala, Thr, Gly, or Val
  VARIANT (1096)..(1096): Lys, Ser, Ala, Thr, Gly, or Val
  VARIANT (1098)..(1098): Lys, Ser, Ala, Thr, Gly, or Val
  VARIANT (1100)..(1100): Lys, Ser, Ala, Thr, Gly, or Val
  VARIANT (1102)..(1102): Lys, Ser, Ala, Thr, Gly, or Val
  VARIANT (1104)..(1104): Lys, Ser, Ala, Thr, Gly, or Val
  VARIANT (1106)..(1106): Lys, Ser, Ala, Thr, Gly, or Val
  VARIANT (1108)..(1108): Lys, Ser, Ala, Thr, Gly, or Val
  VARIANT (1110)..(1110): Lys, Ser, Ala, Thr, Gly, or Val
  VARIANT (1112)..(1112): Lys, Ser, Ala, Thr, Gly, or Val
  VARIANT (1114)..(1114): Lys, Ser, Ala, Thr, Gly, or Val
  VARIANT (1116)..(1116): Lys, Ser, Ala, Thr, Gly, or Val
  VARIANT (1118)..(1118): Lys, Ser, Ala, Thr, Gly, or Val
  VARIANT (1120)..(1120): Lys, Ser, Ala, Thr, Gly, or Val
  VARIANT (1122)..(1122): Lys, Ser, Ala, Thr, Gly, or Val
  VARIANT (1124)..(1124): Lys, Ser, Ala, Thr, Gly, or Val
  VARIANT (1126)..(1126): Lys, Ser, Ala, Thr, Gly, or Val
  VARIANT (1128)..(1128): Lys, Ser, Ala, Thr, Gly, or Val
  VARIANT (1130)..(1130): Lys, Ser, Ala, Thr, Gly, or Val
  VARIANT (1132)..(1132): Lys, Ser, Ala, Thr, Gly, or Val
  VARIANT (1134)..(1134): Lys, Ser, Ala, Thr, Gly, or Val
  VARIANT (1136)..(1136): Lys, Ser, Ala, Thr, Gly, or Val
  VARIANT (1138)..(1138): Lys, Ser, Ala, Thr, Gly, or Val
  VARIANT (1140)..(1140): Lys, Ser, Ala, Thr, Gly, or Val
  VARIANT (1142)..(1142): Lys, Ser, Ala, Thr, Gly, or Val
  VARIANT (1144)..(1144): Lys, Ser, Ala, Thr, Gly, or Val
  VARIANT (1146)..(1146): Lys, Ser, Ala, Thr, Gly, or Val
  VARIANT (1148)..(1148): Lys, Ser, Ala, Thr, Gly, or Val
  VARIANT (1150)..(1150): Lys, Ser, Ala, Thr, Gly, or Val
  VARIANT (1152)..(1152): Lys, Ser, Ala, Thr, Gly, or Val
  VARIANT (1154)..(1154): Lys, Ser, Ala, Thr, Gly, or Val
  VARIANT (1156)..(1156): Lys, Ser, Ala, Thr, Gly, or Val
  VARIANT (1158)..(1158): Lys, Ser, Ala, Thr, Gly, or Val
  VARIANT (1160)..(1160): Lys, Ser, Ala, Thr, Gly, or Val
  VARIANT (1162)..(1162): Lys, Ser, Ala, Thr, Gly, or Val
  VARIANT (1164)..(1164): Lys, Ser, Ala, Thr, Gly, or Val
  VARIANT (1166)..(1166): Lys, Ser, Ala, Thr, Gly, or Val
  VARIANT (1168)..(1168): Lys, Ser, Ala, Thr, Gly, or Val
  VARIANT (1170)..(1170): Lys, Ser, Ala, Thr, Gly, or Val
  VARIANT (1172)..(1172): Lys, Ser, Ala, Thr, Gly, or Val
  VARIANT (1174)..(1174): Lys, Ser, Ala, Thr, Gly, or Val
  VARIANT (1176)..(1176): Lys, Ser, Ala, Thr, Gly, or Val
  VARIANT (1178)..(1178): Lys, Ser, Ala, Thr, Gly, or Val
  VARIANT (1180)..(1180): Lys, Ser, Ala, Thr, Gly, or Val
  VARIANT (1182)..(1182): Lys, Ser, Ala, Thr, Gly, or Val
  VARIANT (1184)..(1184): Lys, Ser, Ala, Thr, Gly, or Val
  VARIANT (1186)..(1186): Lys, Ser, Ala, Thr, Gly, or Val
  VARIANT (1188)..(1188): Lys, Ser, Ala, Thr, Gly, or Val
  VARIANT (1190)..(1190): Lys, Ser, Ala, Thr, Gly, or Val
  VARIANT (1192)..(1192): Lys, Ser, Ala, Thr, Gly, or Val
  VARIANT (1194)..(1194): Lys, Ser, Ala, Thr, Gly, or Val
  VARIANT (1196)..(1196): Lys, Ser, Ala, Thr, Gly, or Val
  VARIANT (1198)..(1198): Lys, Ser, Ala, Thr, Gly, or Val
  VARIANT (1200)..(1200): Lys, Ser, Ala, Thr, Gly, or Val
  VARIANT (1202)..(1202): Lys, Ser, Ala, Thr, Gly, or Val
  VARIANT (1204)..(1204): Lys, Ser, Ala, Thr, Gly, or Val
  VARIANT (1206)..(1206): Lys, Ser, Ala, Thr, Gly, or Val
  VARIANT (1208)..(1208): Lys, Ser, Ala, Thr, Gly, or Val
  VARIANT (1210)..(1210): Lys, Ser, Ala, Thr, Gly, or Val
  VARIANT (1212)..(1212): Lys, Ser, Ala, Thr, Gly, or Val
  VARIANT (1214)..(1214): Lys, Ser, Ala, Thr, Gly, or Val
  VARIANT (1216)..(1216): Lys, Ser, Ala, Thr, Gly, or Val
  VARIANT (1218)..(1218): Lys, Ser, Ala, Thr, Gly, or Val
  VARIANT (1220)..(1220): Lys, Ser, Ala, Thr, Gly, or Val
  VARIANT (1222)..(1222): Lys, Ser, Ala, Thr, Gly, or Val
  VARIANT (1224)..(1224): Lys, Ser, Ala, Thr, Gly, or Val
  VARIANT (1226)..(1226): Lys, Ser, Ala, Thr, Gly, or Val
  VARIANT (1228)..(1228): Lys, Ser, Ala, Thr, Gly, or Val
  VARIANT (1230)..(1230): Lys, Ser, Ala, Thr, Gly, or Val
  VARIANT (1232)..(1232): Lys, Ser, Ala, Thr, Gly, or Val
  VARIANT (1234)..(1234): Lys, Ser, Ala, Thr, Gly, or Val
  VARIANT (1236)..(1236): Lys, Ser, Ala, Thr, Gly, or Val
  VARIANT (1238)..(1238): Lys, Ser, Ala, Thr, Gly, or Val
  VARIANT (1240)..(1240): Lys, Ser, Ala, Thr, Gly, or Val
  VARIANT (1242)..(1242): Lys, Ser, Ala, Thr, Gly, or Val
  VARIANT (1244)..(1244): Lys, Ser, Ala, Thr, Gly, or Val
  VARIANT (1246)..(1246): Lys, Ser, Ala, Thr, Gly, or Val
  VARIANT (1248)..(1248): Lys, Ser, Ala, Thr, Gly, or Val
  VARIANT (1250)..(1250): Lys, Ser, Ala, Thr, Gly, or Val
  VARIANT (1252)..(1252): Lys, Ser, Ala, Thr, Gly, or Val
  VARIANT (1254)..(1254): Lys, Ser, Ala, Thr, Gly, or Val
  VARIANT (1256)..(1256): Lys, Ser, Ala, Thr, Gly, or Val
  VARIANT (1258)..(1258): Lys, Ser, Ala, Thr, Gly, or Val
  VARIANT (1260)..(1260): Lys, Ser, Ala, Thr, Gly, or Val
  VARIANT (1262)..(1262): Lys, Ser, Ala, Thr, Gly, or Val
  VARIANT (1264)..(1264): Lys, Ser, Ala, Thr, Gly, or Val
  VARIANT (1266)..(1266): Lys, Ser, Ala, Thr, Gly, or Val
  VARIANT (1268)..(1268): Lys, Ser, Ala, Thr, Gly, or Val
  VARIANT (1270)..(1270): Lys, Ser, Ala, Thr, Gly, or Val
  VARIANT (1272)..(1272): Lys, Ser, Ala, Thr, Gly, or Val
  VARIANT (1274)..(1274): Lys, Ser, Ala, Thr, Gly, or Val
  VARIANT (1276)..(1276): Lys, Ser, Ala, Thr, Gly, or Val
  VARIANT (1278)..(1278): Lys, Ser, Ala, Thr, Gly, or Val
  VARIANT (1280)..(1280): Lys, Ser, Ala, Thr, Gly, or Val
  VARIANT (1282)..(1282): Lys, Ser, Ala, Thr, Gly, or Val
  VARIANT (1284)..(1284): Lys, Ser, Ala, Thr, Gly, or Val
  VARIANT (1286)..(1286): Lys, Ser, Ala, Thr, Gly, or Val
  VARIANT (1288)..(1288): Lys, Ser, Ala, Thr, Gly, or Val
  VARIANT (1290)..(1290): Lys, Ser, Ala, Thr, Gly, or Val
  VARIANT (1292)..(1292): Lys, Ser, Ala, Thr, Gly, or Val
  VARIANT (1294)..(1294): Lys, Ser, Ala, Thr, Gly, or Val
  VARIANT (1296)..(1296): Lys, Ser, Ala, Thr, Gly, or Val
  VARIANT (1298)..(1298): Lys, Ser, Ala, Thr, Gly, or Val
  VARIANT (1300)..(1300): Lys, Ser, Ala, Thr, Gly, or Val
  VARIANT (1302)..(1302): Lys, Ser, Ala, Thr, Gly, or Val
  VARIANT (1304)..(1304): Lys, Ser, Ala, Thr, Gly, or Val
  VARIANT (1306)..(1306): Lys, Ser, Ala, Thr, Gly, or Val
  VARIANT (1308)..(1308): Lys, Ser, Ala, Thr, Gly, or Val
  VARIANT (1310)..(1310): Lys, Ser, Ala, Thr, Gly, or Val
  VARIANT (1312)..(1312): Lys, Ser, Ala, Thr, Gly, or Val
  VARIANT (1314)..(1314): Lys, Ser, Ala, Thr, Gly, or Val
  VARIANT (1316)..(1316): Lys, Ser, Ala, Thr, Gly, or Val
  VARIANT (1318)..(1318): Lys, Ser, Ala, Thr, Gly, or Val
  VARIANT (1320)..(1320): Lys, Ser, Ala, Thr, Gly, or Val
  VARIANT (1322)..(1322): Lys, Ser, Ala, Thr, Gly, or Val
  VARIANT (1324)..(1324): Lys, Ser, Ala, Thr, Gly, or Val
  VARIANT (1326)..(1326): Lys, Ser, Ala, Thr, Gly, or Val
  VARIANT (1328)..(1328): Lys, Ser, Ala, Thr, Gly, or Val
  VARIANT (1330)..(1330): Lys, Ser, Ala, Thr, Gly, or Val
  VARIANT (1332)..(1332): Lys, Ser, Ala, Thr, Gly, or Val
  VARIANT (1334)..(1334): Lys, Ser, Ala, Thr, Gly, or Val
  VARIANT (1336)..(1336): Lys, Ser, Ala, Thr, Gly, or Val
  VARIANT (1338)..(1338): Lys, Ser, Ala, Thr, Gly, or Val
  VARIANT (1340)..(1340): Lys, Ser, Ala, Thr, Gly, or Val
  VARIANT (1342)..(1342): Lys, Ser, Ala, Thr, Gly, or Val
  VARIANT (1344)..(1344): Lys, Ser, Ala, Thr, Gly, or Val
  VARIANT (1346)..(1346): Lys, Ser, Ala, Thr, Gly, or Val
  VARIANT (1348)..(1348): Lys, Ser, Ala, Thr, Gly, or Val
  VARIANT (1350)..(1350): Lys, Ser, Ala, Thr, Gly, or Val
  VARIANT (1352)..(1352): Lys, Ser, Ala, Thr, Gly, or Val
  VARIANT (1354)..(1354): Lys, Ser, Ala, Thr, Gly, or Val
  VARIANT (1356)..(1356): Lys, Ser, Ala, Thr, Gly, or Val
  VARIANT (1358)..(1358): Lys, Ser, Ala, Thr, Gly, or Val
  VARIANT (1360)..(1360): Lys, Ser, Ala, Thr, Gly, or Val
  VARIANT (1362)..(1362): Lys, Ser, Ala, Thr, Gly, or Val
  VARIANT (1364)..(1364): Lys, Ser, Ala, Thr, Gly, or Val
  VARIANT (1366)..(1366): Lys, Ser, Ala, Thr, Gly, or Val
  VARIANT (1368)..(1368): Lys, Ser, Ala, Thr, Gly, or Val
  VARIANT (1370)..(1370): Lys, Ser, Ala, Thr, Gly, or Val
  VARIANT (1372)..(1372): Lys, Ser, Ala, Thr, Gly, or Val
  VARIANT (1374)..(1374): Lys, Ser, Ala, Thr, Gly, or Val
  VARIANT (1376)..(1376): Lys, Ser, Ala, Thr, Gly, or Val
  VARIANT (1378)..(1378): Lys, Ser, Ala, Thr, Gly, or Val
  VARIANT (1380)..(1380): Lys, Ser, Ala, Thr, Gly, or Val
  VARIANT (1382)..(1382): Lys, Ser, Ala, Thr, Gly, or Val
  VARIANT (1384)..(1384): Lys, Ser, Ala, Thr, Gly, or Val
  VARIANT (1386)..(1386): Lys, Ser, Ala, Thr, Gly, or Val
  VARIANT (1388)..(1388): Lys, Ser, Ala, Thr, Gly, or Val
  VARIANT (1390)..(1390): Lys, Ser, Ala, Thr, Gly, or Val
  VARIANT (1392)..(1392): Lys, Ser, Ala, Thr, Gly, or Val
  VARIANT (1394)..(1394): Lys, Ser, Ala, Thr, Gly, or Val
  VARIANT (1396)..(1396): Lys, Ser, Ala, Thr, Gly, or Val
  VARIANT (1398)..(1398): Lys, Ser, Ala, Thr, Gly, or Val
  VARIANT (1400)..(1400): Lys, Ser, Ala, Thr, Gly, or Val
  VARIANT (1402)..(1402): Lys, Ser, Ala, Thr, Gly, or Val
  VARIANT (1404)..(1404): Lys, Ser, Ala, Thr, Gly, or Val
  VARIANT (1406)..(1406): Lys, Ser, Ala, Thr, Gly, or Val
  VARIANT (1408)..(1408): Lys, Ser, Ala, Thr, Gly, or Val
  VARIANT (1410)..(1410): Lys, Ser, Ala, Thr, Gly, or Val
  VARIANT (1412)..(1412): Lys, Ser, Ala, Thr, Gly, or Val
  VARIANT (1414)..(1414): Lys, Ser, Ala, Thr, Gly, or Val
  VARIANT (1416)..(1416): Lys, Ser, Ala, Thr, Gly, or Val
  VARIANT (1418)..(1418): Lys, Ser, Ala, Thr, Gly, or Val
  VARIANT (1420)..(1420): Lys, Ser, Ala, Thr, Gly, or Val
  VARIANT (1422)..(1422): Lys, Ser, Ala, Thr, Gly, or Val
  VARIANT (1424)..(1424): Lys, Ser, Ala, Thr, Gly, or Val
  VARIANT (1426)..(1426): Lys, Ser, Ala, Thr, Gly, or Val
  VARIANT (1428)..(1428): Lys, Ser, Ala, Thr, Gly, or Val
  VARIANT (1430)..(1430): Lys, Ser, Ala, Thr, Gly, or Val
  VARIANT (1432)..(1432): Lys, Ser, Ala, Thr, Gly, or Val
  VARIANT (1434)..(1434): Lys, Ser, Ala, Thr, Gly, or Val
  VARIANT (1436)..(1436): Lys, Ser, Ala, Thr, Gly, or Val
  VARIANT (1438)..(1438): Lys, Ser, Ala, Thr, Gly, or Val
  VARIANT (1440)..(1440): Lys, Ser, Ala, Thr, Gly, or Val
  VARIANT (1442)..(1442): Lys, Ser, Ala, Thr, Gly, or Val
  VARIANT (1444)..(1444): Lys, Ser, Ala, Thr, Gly, or Val
  VARIANT (1446)..(1446): Lys, Ser, Ala, Thr, Gly, or Val
  VARIANT (1448)..(1448): Lys, Ser, Ala, Thr, Gly, or Val
  VARIANT (1450)..(1450): Lys, Ser, Ala, Thr, Gly, or Val
  VARIANT (1452)..(1452): Lys, Ser, Ala, Thr, Gly, or Val
  VARIANT (1454)..(1454): Lys, Ser, Ala, Thr, Gly, or Val
  VARIANT (1456)..(1456): Lys, Ser, Ala, Thr, Gly, or Val
  VARIANT (1458)..(1458): Lys, Ser, Ala, Thr, Gly, or Val
  VARIANT (1460)..(1460): Lys, Ser, Ala, Thr, Gly, or Val
  VARIANT (1462)..(1462): Lys, Ser, Ala, Thr, Gly, or Val
  VARIANT (1464)..(1464): Lys, Ser, Ala, Thr, Gly, or Val
  VARIANT (1466)..(1466): Lys, Ser, Ala, Thr, Gly, or Val
  VARIANT (1468)..(1468): Lys, Ser, Ala, Thr, Gly, or Val
  VARIANT (1470)..(1470): Lys, Ser, Ala, Thr, Gly, or Val
  VARIANT (1472)..(1472): Lys, Ser, Ala, Thr, Gly, or Val
  VARIANT (1474)..(1474): Lys, Ser, Ala, Thr, Gly, or Val
  VARIANT (1476)..(1476): Lys, Ser, Ala, Thr, Gly, or Val
  VARIANT (1478)..(1478): Lys, Ser, Ala, Thr, Gly, or Val
  VARIANT (1480)..(1480): Lys, Ser, Ala, Thr, Gly, or Val
  VARIANT (1482)..(1482): Lys, Ser, Ala, Thr, Gly, or Val
  VARIANT (1484)..(1484): Lys, Ser, Ala, Thr, Gly, or Val
  VARIANT (1486)..(1486): Lys, Ser, Ala, Thr, Gly, or Val
  VARIANT (1488)..(1488): Lys, Ser, Ala, Thr, Gly, or Val
  VARIANT (1490)..(1490): Lys, Ser, Ala, Thr, Gly, or Val
  VARIANT (1492)..(1492): Lys, Ser, Ala, Thr, Gly, or Val
  VARIANT (1494)..(1494): Lys, Ser, Ala, Thr, Gly, or Val
  VARIANT (1496)..(1496): Lys, Ser, Ala, Thr, Gly, or Val
  VARIANT (1498)..(1498): Lys, Ser, Ala, Thr, Gly, or Val
  VARIANT (1500)..(1500): Lys, Ser, Ala, Thr, Gly, or Val
  VARIANT (1502)..(1502): Lys, Ser, Ala, Thr, Gly, or Val
  VARIANT (1504)..(1504): Lys, Ser, Ala, Thr, Gly, or Val
  VARIANT (1506)..(1506): Lys, Ser, Ala, Thr, Gly, or Val
  VARIANT (1508)..(1508): Lys, Ser, Ala, Thr, Gly, or Val
  VARIANT (1510)..(1510): Lys, Ser, Ala, Thr, Gly, or Val
  VARIANT (1512)..(1512): Lys, Ser, Ala, Thr, Gly, or Val
  VARIANT (1514)..(1514): Lys, Ser, Ala, Thr, Gly, or Val
  VARIANT (1516)..(1516): Lys, Ser, Ala, Thr, Gly, or Val
  VARIANT (1518)..(1518): Lys, Ser, Ala, Thr, Gly, or Val
  VARIANT (1520)..(1520): Lys, Ser, Ala, Thr, Gly, or Val
  VARIANT (1522)..(1522): Lys, Ser, Ala, Thr, Gly, or Val
  VARIANT (1524)..(1524): Lys, Ser, Ala, Thr, Gly, or Val
  VARIANT (1526)..(1526): Lys, Ser, Ala, Thr, Gly, or Val
  VARIANT (1528)..(1528): Lys, Ser, Ala, Thr, Gly, or Val
  VARIANT (1530)..(1530): Lys, Ser, Ala, Thr, Gly, or Val
  VARIANT (1532)..(1532): Lys, Ser, Ala, Thr, Gly, or Val
  VARIANT (1534)..(1534): Lys, Ser, Ala, Thr, Gly, or Val
  VARIANT (1536)..(1536): Lys, Ser, Ala, Thr, Gly, or Val
  VARIANT (1538)..(1538): Lys, Ser, Ala, Thr, Gly, or Val
  VARIANT (1540)..(1540): Lys, Ser, Ala, Thr, Gly, or Val
  VARIANT (1542)..(1542): Lys, Ser, Ala, Thr, Gly, or Val
  VARIANT (1544)..(1544): Lys, Ser, Ala, Thr, Gly, or Val
  VARIANT (1546)..(1546): Lys, Ser, Ala, Thr, Gly, or Val
  VARIANT (1548)..(1548): Lys, Ser, Ala, Thr, Gly, or Val
  VARIANT (1550)..(1550): Lys, Ser, Ala, Thr, Gly, or Val
  VARIANT (1552)..(1552): Lys, Ser, Ala, Thr, Gly, or Val
  VARIANT (1554)..(1554): Lys, Ser, Ala, Thr, Gly, or Val
  VARIANT (1556)..(1556): Lys, Ser, Ala, Thr, Gly, or Val
  VARIANT (1558)..(1558): Lys, Ser, Ala, Thr, Gly, or Val
  VARIANT (1560)..(1560): Lys, Ser, Ala, Thr, Gly, or Val
  VARIANT (1562)..(1562): Lys, Ser, Ala, Thr, Gly, or Val
  VARIANT (1564)..(1564): Lys, Ser, Ala, Thr, Gly, or Val
  VARIANT (1566)..(1566): Lys, Ser, Ala, Thr, Gly, or Val
  VARIANT (1568)..(1568): Lys, Ser, Ala, Thr, Gly, or Val
  VARIANT (1570)..(1570): Lys, Ser, Ala, Thr, Gly, or Val
  VARIANT (1572)..(1572): Lys, Ser, Ala, Thr, Gly, or Val
  VARIANT (1574)..(1574): Lys, Ser, Ala, Thr, Gly, or Val
  VARIANT (1576)..(1576): Lys, Ser, Ala, Thr, Gly, or Val
  VARIANT (1578)..(1578): Lys, Ser, Ala, Thr, Gly, or Val
  VARIANT (1580)..(1580): Lys, Ser, Ala, Thr, Gly, or Val
  VARIANT (1582)..(1582): Lys, Ser, Ala, Thr, Gly, or Val
  VARIANT (1584)..(1584): Lys, Ser, Ala, Thr, Gly, or Val
  VARIANT (1586)..(1586): Lys, Ser, Ala, Thr, Gly, or Val
  VARIANT (1588)..(1588): Lys, Ser, Ala, Thr, Gly, or Val
  VARIANT (1590)..(1590): Lys, Ser, Ala, Thr, Gly, or Val
  VARIANT (1592)..(1592): Lys, Ser, Ala, Thr, Gly, or Val
  VARIANT (1594)..(1594): Lys, Ser, Ala, Thr, Gly, or Val
  VARIANT (1596)..(1596): Lys, Ser, Ala, Thr, Gly, or Val
  VARIANT (1598)..(1598): Lys, Ser, Ala, Thr, Gly, or Val
  VARIANT (1600)..(1600): Lys, Ser, Ala, Thr, Gly, or Val
  VARIANT (1602)..(1602): Lys, Ser, Ala, Thr, Gly, or Val
  VARIANT (1604)..(1604): Lys, Ser, Ala, Thr, Gly, or Val
  VARIANT (1606)..(1606): Lys, Ser, Ala, Thr, Gly, or Val
  VARIANT (1608)..(1608): Lys, Ser, Ala, Thr, Gly, or Val
  VARIANT (1610)..(1610): Lys, Ser, Ala, Thr, Gly, or Val
  VARIANT (1612)..(1612): Lys, Ser, Ala, Thr, Gly, or Val
  VARIANT (1614)..(1614): Lys, Ser, Ala, Thr, Gly, or Val
  VARIANT (1616)..(1616): Lys, Ser, Ala, Thr, Gly, or Val
  VARIANT (1618)..(1618): Lys, Ser, Ala, Thr, Gly, or Val
  VARIANT (1620)..(1620): Lys, Ser, Ala, Thr, Gly, or Val
  VARIANT (1622)..(1622): Lys, Ser, Ala, Thr, Gly, or Val
  VARIANT (1624)..(1624): Lys, Ser, Ala, Thr, Gly, or Val
  VARIANT (1626)..(1626): Lys, Ser, Ala, Thr, Gly, or Val
  VARIANT (1628)..(1628): Lys, Ser, Ala, Thr, Gly, or Val
  VARIANT (1630)..(1630): Lys, Ser, Ala, Thr, Gly, or Val
  VARIANT (1632)..(1632): Lys, Ser, Ala, Thr, Gly, or Val
  VARIANT (1634)..(1634): Lys, Ser, Ala, Thr, Gly, or Val
  VARIANT (1636)..(1636): Lys, Ser, Ala, Thr, Gly, or Val
  VARIANT (1638)..(1638): Lys, Ser, Ala, Thr, Gly, or Val
  VARIANT (1640)..(1640): Lys, Ser, Ala, Thr, Gly, or Val
  VARIANT (1642)..(1642): Lys, Ser, Ala, Thr, Gly, or Val
  VARIANT (1644)..(1644): Lys, Ser, Ala, Thr, Gly, or Val
  VARIANT (1646)..(1646): Lys, Ser, Ala, Thr, Gly, or Val
  VARIANT (1648)..(1648): Lys, Ser, Ala, Thr, Gly, or Val
  VARIANT (1650)..(1650): Lys, Ser, Ala, Thr, Gly, or Val
  VARIANT (1652)..(1652): Lys, Ser, Ala, Thr, Gly, or Val
  VARIANT (1654)..(1654): Lys, Ser, Ala, Thr, Gly, or Val
  VARIANT (1656)..(1656): Lys, Ser, Ala, Thr, Gly, or Val
  VARIANT (1658)..(1658): Lys, Ser, Ala, Thr, Gly, or Val
  VARIANT (1660)..(1660): Lys, Ser, Ala, Thr, Gly, or Val
  VARIANT (1662)..(1662): Lys, Ser, Ala, Thr, Gly, or Val
  VARIANT (1664)..(1664): Lys, Ser, Ala, Thr, Gly, or Val
  VARIANT (1666)..(1666): Lys, Ser, Ala, Thr, Gly, or Val
  VARIANT (1668)..(1668): Lys, Ser, Ala, Thr, Gly, or Val
  VARIANT (1670)..(1670): Lys, Ser, Ala, Thr, Gly, or Val
  VARIANT (1672)..(1672): Lys, Ser, Ala, Thr, Gly, or Val
  VARIANT (1674)..(1674): Lys, Ser, Ala, Thr, Gly, or Val
  VARIANT (1676)..(1676): Lys, Ser, Ala, Thr, Gly, or Val
  VARIANT (1678)..(1678): Lys, Ser, Ala, Thr, Gly, or Val
  VARIANT (1680)..(1680): Lys, Ser, Ala, Thr, Gly, or Val
  VARIANT (1682)..(1682): Lys, Ser, Ala, Thr, Gly, or Val
  VARIANT (1684)..(1684): Lys, Ser, Ala, Thr, Gly, or Val
  VARIANT (1686)..(1686): Lys, Ser, Ala, Thr, Gly, or Val
  VARIANT (1688)..(1688): Lys, Ser, Ala, Thr, Gly, or Val
  VARIANT (1690)..(1690): Lys, Ser, Ala, Thr, Gly, or Val
  VARIANT (1692)..(1692): Lys, Ser, Ala, Thr, Gly, or Val
  VARIANT (1694)..(1694): Lys, Ser, Ala, Thr, Gly, or Val
  VARIANT (1696)..(1696): Lys, Ser, Ala, Thr, Gly, or Val
  VARIANT (1698)..(1698): Lys, Ser, Ala, Thr, Gly, or Val
  VARIANT (1700)..(1700): Lys, Ser, Ala, Thr, Gly, or Val
  VARIANT (1702)..(1702): Lys, Ser, Ala, Thr, Gly, or Val
  VARIANT (1704)..(1704): Lys, Ser, Ala, Thr, Gly, or Val
  VARIANT (1706)..(1706): Lys, Ser, Ala, Thr, Gly, or Val
  VARIANT (1708)..(1708): Lys, Ser, Ala, Thr, Gly, or Val
  VARIANT (1710)..(1710): Lys, Ser, Ala, Thr, Gly, or Val
  VARIANT (1712)..(1712): Lys, Ser, Ala, Thr, Gly, or Val
  VARIANT (1714)..(1714): Lys, Ser, Ala, Thr, Gly, or Val
  VARIANT (1716)..(1716): Lys, Ser, Ala, Thr, Gly, or Val
  VARIANT (1718)..(1718): Lys, Ser, Ala, Thr, Gly, or Val
  VARIANT (1720)..(1720): Lys, Ser, Ala, Thr, Gly, or Val
  VARIANT (1722)..(1722): Lys, Ser, Ala, Thr, Gly, or Val
  VARIANT (1724)..(1724): Lys, Ser, Ala, Thr, Gly, or Val
  VARIANT (1726)..(1726): Lys, Ser, Ala, Thr, Gly, or Val
  VARIANT (1728)..(1728): Lys, Ser, Ala, Thr, Gly, or Val
  VARIANT (1730)..(1730): Lys, Ser, Ala, Thr, Gly, or Val
  VARIANT (1732)..(1732): Lys, Ser, Ala, Thr, Gly, or Val
  VARIANT (1734)..(1734): Lys, Ser, Ala, Thr, Gly, or Val
  VARIANT (1736)..(1736): Lys, Ser, Ala, Thr, Gly, or Val
  VARIANT (1738)..(1738): Lys, Ser, Ala, Thr, Gly, or Val
  VARIANT (1740)..(1740): Lys, Ser, Ala, Thr, Gly, or Val
  VARIANT (1742)..(1742): Lys, Ser, Ala, Thr, Gly, or Val
  VARIANT (1744)..(1744): Lys, Ser, Ala, Thr, Gly, or Val
  VARIANT (1746)..(1746): Lys, Ser, Ala, Thr, Gly, or Val
  VARIANT (1748)..(1748): Lys, Ser, Ala, Thr, Gly, or Val
  VARIANT (1750)..(1750): Lys, Ser, Ala, Thr, Gly, or Val
  VARIANT (1752)..(1752): Lys, Ser, Ala, Thr, Gly, or Val
  VARIANT (1754)..(1754): Lys, Ser, Ala, Thr, Gly, or Val
  VARIANT (1756)..(1756): Lys, Ser, Ala, Thr, Gly, or Val
  VARIANT (1758)..(1758): Lys, Ser, Ala, Thr, Gly, or Val
  VARIANT (1760)..(1760): Lys, Ser, Ala, Thr, Gly, or Val
  VARIANT (1762)..(1762): Lys, Ser, Ala, Thr, Gly, or Val
  VARIANT (1764)..(1764): Lys, Ser, Ala, Thr, Gly, or Val
  VARIANT (1766)..(1766): Lys, Ser, Ala, Thr, Gly, or Val
  VARIANT (1768)..(1768): Lys, Ser, Ala, Thr, Gly, or Val
  VARIANT (1770)..(1770): Lys, Ser, Ala, Thr, Gly, or Val
  VARIANT (1772)..(1772): Lys, Ser, Ala, Thr, Gly, or Val
  VARIANT (1774)..(1774): Lys, Ser, Ala, Thr, Gly, or Val
  VARIANT (1776)..(1776): Lys, Ser, Ala, Thr, Gly, or Val
  VARIANT (1778)..(1778): Lys, Ser, Ala, Thr, Gly, or Val
  VARIANT (1780)..(1780): Lys, Ser, Ala, Thr, Gly, or Val
  VARIANT (1782)..(1782): Lys, Ser, Ala, Thr, Gly, or Val
  VARIANT (1784)..(1784): Lys, Ser, Ala, Thr, Gly, or Val
  VARIANT (1786)..(1786): Lys, Ser, Ala, Thr, Gly, or Val
  VARIANT (1788)..(1788): Lys, Ser, Ala, Thr, Gly, or Val
  VARIANT (1790)..(1790): Lys, Ser, Ala, Thr, Gly, or Val
  VARIANT (1792)..(1792): Lys, Ser, Ala, Thr, Gly, or Val
  VARIANT (1794)..(1794): Lys, Ser, Ala, Thr, Gly, or Val
  VARIANT (1796)..(1796): Lys, Ser, Ala, Thr, Gly, or Val
  VARIANT (1798)..(1798): Lys, Ser, Ala, Thr, Gly, or Val
  VARIANT (1800)..(1800): Lys, Ser, Ala, Thr, Gly, or Val
  VARIANT (1802)..(1802): Lys, Ser, Ala, Thr, Gly, or Val
  VARIANT (1804)..(1804): Lys, Ser, Ala, Thr, Gly, or Val
  VARIANT (1806)..(1806): Lys, Ser, Ala, Thr, Gly, or Val
  VARIANT (1808)..(1808): Lys, Ser, Ala, Thr, Gly, or Val
  VARIANT (1810)..(1810): Lys, Ser, Ala, Thr, Gly, or Val
  VARIANT (1812)..(1812): Lys, Ser, Ala, Thr, Gly, or Val
  VARIANT (1814)..(1814): Lys, Ser, Ala, Thr, Gly, or Val
  VARIANT (1816)..(1816): Lys, Ser, Ala, Thr, Gly, or Val
  VARIANT (1818)..(1818): Lys, Ser, Ala, Thr, Gly, or Val
  VARIANT (1820)..(1820): Lys, Ser, Ala, Thr, Gly, or Val
  VARIANT (1822)..(1822): Lys, Ser, Ala, Thr, Gly, or Val
  VARIANT (1824)..(1824): Lys, Ser, Ala, Thr, Gly, or Val
  VARIANT (1826)..(1826): Lys, Ser, Ala, Thr, Gly, or Val
  VARIANT (1828)..(1828): Lys, Ser, Ala, Thr, Gly, or Val
  VARIANT (1830)..(1830): Lys, Ser, Ala, Thr, Gly, or Val
  VARIANT (1832)..(1832): Lys, Ser, Ala, Thr, Gly, or Val
  VARIANT (1834)..(1834): Lys, Ser, Ala, Thr, Gly, or Val
  VARIANT (1836)..(1836): Lys, Ser, Ala, Thr, Gly, or Val
  VARIANT (1838)..(1838): Lys, Ser, Ala, Thr, Gly, or Val
  VARIANT (1840)..(1840): Lys, Ser, Ala, Thr, Gly, or Val
  VARIANT (1842)..(1842): Lys, Ser, Ala, Thr, Gly, or Val
  VARIANT (1844)..(1844): Lys, Ser, Ala, Thr, Gly, or Val
  VARIANT (1846)..(1846): Lys, Ser, Ala, Thr, Gly, or Val
  VARIANT (1848)..(1848): Lys, Ser, Ala, Thr, Gly, or Val
  VARIANT (1850)..(1850): Lys, Ser, Ala, Thr, Gly, or Val
  VARIANT (1852)..(1852): Lys, Ser, Ala, Thr, Gly, or Val
  VARIANT (1854)..(1854): Lys, Ser, Ala, Thr, Gly, or Val
  VARIANT (1856)..(1856): Lys, Ser, Ala, Thr, Gly, or Val
  VARIANT (1858)..(1858): Lys, Ser, Ala, Thr, Gly, or Val
  VARIANT (1860)..(1860): Lys, Ser, Ala, Thr, Gly, or Val
  VARIANT (1862)..(1862): Lys, Ser, Ala, Thr, Gly, or Val
  VARIANT (1864)..(1864): Lys, Ser, Ala, Thr, Gly, or Val
  VARIANT (1866)..(1866): Lys, Ser, Ala, Thr, Gly, or Val
  VARIANT (1868)..(1868): Lys, Ser, Ala, Thr, Gly, or Val
  VARIANT (1870)..(1870): Lys, Ser, Ala, Thr, Gly, or Val
  VARIANT (1872)..(1872): Lys, Ser, Ala, Thr, Gly, or Val
  VARIANT (1874)..(1874): Lys, Ser, Ala, Thr, Gly, or Val
  VARIANT (1876)..(1876): Lys, Ser, Ala, Thr, Gly, or Val
  VARIANT (1878)..(1878): Lys, Ser, Ala, Thr, Gly, or Val
  VARIANT (1880)..(1880): Lys, Ser, Ala, Thr, Gly, or Val
  VARIANT (1882)..(1882): Lys, Ser, Ala, Thr, Gly, or Val
  VARIANT (1884)..(1884): Lys, Ser, Ala, Thr, Gly, or Val
  VARIANT (1886)..(1886): Lys, Ser, Ala, Thr, Gly, or Val
  VARIANT (1888)..(1888): Lys, Ser, Ala, Thr, Gly, or Val
  VARIANT (1890)..(1890): Lys, Ser, Ala, Thr, Gly, or Val
  VARIANT (1892)..(1892): Lys, Ser, Ala, Thr, Gly, or Val
  VARIANT (1894)..(1894): Lys, Ser, Ala, Thr, Gly, or Val
  VARIANT (1896)..(1896): Lys, Ser, Ala, Thr, Gly, or Val
  VARIANT (1898)..(1898): Lys, Ser, Ala, Thr, Gly, or Val
  VARIANT (1900)..(1900): Lys, Ser, Ala, Thr, Gly, or Val
  VARIANT (1902)..(1902): Lys, Ser, Ala, Thr, Gly, or Val
  VARIANT (1904)..(1904): Lys, Ser, Ala, Thr, Gly, or Val
  VARIANT (1906)..(1906): Lys, Ser, Ala, Thr, Gly, or Val
  VARIANT (1908)..(1908): Lys, Ser, Ala, Thr, Gly, or Val
  VARIANT (1910)..(1910): Lys, Ser, Ala, Thr, Gly, or Val
  VARIANT (1912)..(1912): Lys, Ser, Ala, Thr, Gly, or Val
  VARIANT (1914)..(1914): Lys, Ser, Ala, Thr, Gly, or Val
  VARIANT (1916)..(1916): Lys, Ser, Ala, Thr, Gly, or Val
  VARIANT (1918)..(1918): Lys, Ser, Ala, Thr, Gly, or Val
  VARIANT (1920)..(1920): Lys, Ser, Ala, Thr, Gly, or Val
  VARIANT (1922)..(1922): Lys, Ser, Ala, Thr, Gly, or Val
  VARIANT (1924)..(1924): Lys, Ser, Ala, Thr, Gly, or Val
  VARIANT (1926)..(1926): Lys, Ser, Ala, Thr, Gly, or Val
  VARIANT (1928)..(1928): Lys, Ser, Ala, Thr, Gly, or Val
  VARIANT (1930)..(1930): Lys, Ser, Ala, Thr, Gly, or Val
  VARIANT (1932)..(1932): Lys, Ser, Ala, Thr, Gly, or Val
  VARIANT (1934)..(1934): Lys, Ser, Ala, Thr, Gly, or Val
  VARIANT (1936)..(1936): Lys, Ser, Ala, Thr, Gly, or Val
  VARIANT (1938)..(1938): Lys, Ser, Ala, Thr, Gly, or Val
  VARIANT (1940)..(1940): Lys, Ser, Ala, Thr, Gly, or Val
  VARIANT (1942)..(1942): Lys, Ser, Ala, Thr, Gly, or Val
  VARIANT (1944)..(1944): Lys, Ser, Ala, Thr, Gly, or Val
  VARIANT (1946)..(1946): Lys, Ser, Ala, Thr, Gly, or Val
  VARIANT (1948)..(1948): Lys, Ser, Ala, Thr, Gly, or Val
  VARIANT (1950)..(1950): Lys, Ser, Ala, Thr, Gly, or Val
  VARIANT (1952)..(1952): Lys, Ser, Ala, Thr, Gly, or Val
  VARIANT (1954)..(1954): Lys, Ser, Ala, Thr, Gly, or Val
  VARIANT (1956)..(1956): Lys, Ser, Ala, Thr, Gly, or Val
  VARIANT (1958)..(1958): Lys, Ser, Ala, Thr, Gly, or Val
  VARIANT (1960)..(1960): Lys, Ser, Ala, Thr, Gly, or Val
  VARIANT (1962)..(1962): Lys, Ser, Ala, Thr, Gly, or Val
  VARIANT (1964)..(1964): Lys, Ser, Ala, Thr, Gly, or Val
  VARIANT (1966)..(1966): Lys, Ser, Ala, Thr, Gly, or Val
  VARIANT (1968)..(1968): Lys, Ser, Ala, Thr, Gly, or Val
  VARIANT (1970)..(1970): Lys, Ser, Ala, Thr, Gly, or Val
  VARIANT (1972)..(1972): Lys, Ser, Ala, Thr, Gly, or Val
  VARIANT (1974)..(1974): Lys, Ser, Ala, Thr, Gly, or Val
  VARIANT (1976)..(1976): Lys, Ser, Ala, Thr, Gly, or Val
  VARIANT (1978)..(1978): Lys, Ser, Ala, Thr, Gly, or Val
  VARIANT (1980)..(1980): Lys, Ser, Ala, Thr, Gly, or Val
  VARIANT (1982)..(1982): Lys, Ser, Ala, Thr, Gly, or Val
  VARIANT (1984)..(1984): Lys, Ser, Ala, Thr, Gly, or Val
  VARIANT (1986)..(1986): Lys, Ser, Ala, Thr, Gly, or Val
  VARIANT (1988)..(1988): Lys, Ser, Ala, Thr, Gly, or Val
  VARIANT (1990)..(1990): Lys, Ser, Ala, Thr, Gly, or Val
  VARIANT (1992)..(1992): Lys, Ser, Ala, Thr, Gly, or Val
  VARIANT (1994)..(1994): Lys, Ser, Ala, Thr, Gly, or Val
  VARIANT (1996)..(1996): Lys, Ser, Ala, Thr, Gly, or Val
  VARIANT (1998)..(1998): Lys, Ser, Ala, Thr, Gly, or Val
  VARIANT (2000)..(2000): Lys, Ser, Ala, Thr, Gly, or Val
  This sequence encompasses at least 1 to 1,000 (Pro-Xaa) repeating units, and subject to having the minumum number of repeating units, any one or more repeating units can either be present or absent
PXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPX

SEQ ID NO: 95 - protein, 1000 aa, Artificial Sequence
  Description of Artificial Sequence: Synthetic amino acid motif
  This sequence encompasses at least 2 to 1,000 residues of Proline, and subject to having the minumum number of Proline residues, any one or more of the residues at positions 1 to 1,000 can either be present or absent
PPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPP

SEQ ID NO: 96 - protein, 1001 aa, Artificial Sequence
  Description of Artificial Sequence: Synthetic amino acid motif
  VARIANT (1001): Lys, Ser, Thr, Ala, Gly, Val, or any amino acid
  This sequence encompasses at least 2 to 1,000 residues of Proline between positions 1 and 1,000, and subject to having the minumum number of Proline residues, any one or more Proline residues at positions 1 to 1,000 can either be present or absent
PPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPX

SEQ ID NO: 97 - protein, 6 aa, Artificial Sequence
  Description of Artificial Sequence: Synthetic peptide
  VARIANT (1): Variable amino acid
XPPPPP

SEQ ID NO: 98 - protein, 5 aa, Artificial Sequence
  Description of Artificial Sequence: Synthetic peptide
SPPPP

SEQ ID NO: 99 - protein, 4 aa, Artificial Sequence
  Description of Artificial Sequence: Synthetic peptide
KSYR

SEQ ID NO: 100 - protein, 4 aa, Artificial Sequence
  Description of Artificial Sequence: Synthetic peptide
RSFR

SEQ ID NO: 101 - protein, 4 aa, Artificial Sequence
  Description of Artificial Sequence: Synthetic peptide
RAYR

SEQ ID NO: 102 - protein, 4 aa, Artificial Sequence
  Description of Artificial Sequence: Synthetic peptide
KTYK

SEQ ID NO: 103 - protein, 4 aa, Artificial Sequence
  Description of Artificial Sequence: Synthetic peptide
RSYR

SEQ ID NO: 104 - protein, 4 aa, Artificial Sequence
  Description of Artificial Sequence: Synthetic peptide
KAYR

SEQ ID NO: 105 - protein, 4 aa, Artificial Sequence
  Description of Artificial Sequence: Synthetic peptide
RFFR

SEQ ID NO: 106 - protein, 4 aa, Artificial Sequence
  Description of Artificial Sequence: Synthetic peptide
KQYR

SEQ ID NO: 107 - protein, 4 aa, Artificial Sequence
  Description of Artificial Sequence: Synthetic peptide
KEFR

SEQ ID NO: 108 - protein, 4 aa, Artificial Sequence
  Description of Artificial Sequence: Synthetic peptide
RTYH

SEQ ID NO: 109 - protein, 4 aa, Artificial Sequence
  Description of Artificial Sequence: Synthetic peptide
QRYR

SEQ ID NO: 110 - protein, 4 aa, Artificial Sequence
  Description of Artificial Sequence: Synthetic peptide
KKYK

SEQ ID NO: 111 - protein, 4 aa, Artificial Sequence
  Description of Artificial Sequence: Synthetic peptide
RSFS

SEQ ID NO: 112 - protein, 4 aa, Artificial Sequence
  Description of Artificial Sequence: Synthetic peptide
KSNR

SEQ ID NO: 113 - protein, 40 aa, Artificial Sequence
  Description of Artificial Sequence: Synthetic peptide motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
  MOD_RES (22)..(22): Hydroxyproline
  MOD_RES (24)..(24): Hydroxyproline
  MOD_RES (26)..(26): Hydroxyproline
  MOD_RES (28)..(28): Hydroxyproline
  MOD_RES (30)..(30): Hydroxyproline
  MOD_RES (32)..(32): Hydroxyproline
  MOD_RES (34)..(34): Hydroxyproline
  MOD_RES (36)..(36): Hydroxyproline
  MOD_RES (38)..(38): Hydroxyproline
  MOD_RES (40)..(40): Hydroxyproline
  This sequence encompasses at least 1 to 20 (Ser-Hyp) repeating units, and subject to having the minumum number of repeating units, any one or more of repeating units can either be present or absent; see specification for a detailed description of preferred embodiments
SXSXSXSXSXSXSXSXSXSXSXSXSXSXSXSXSXSXSXSX

SEQ ID NO: 114 - protein, 19 aa, Artificial Sequence
  Description of Artificial Sequence: Synthetic amino acid consensus motif
  MOD_RES (2)..(4): Hydroxyproline
  MOD_RES (5): Hydroxyproline, Thr, or Ser
  MOD_RES (8)..(8): Hydroxyproline
  MOD_RES (10)..(10): Hydroxyproline
  MOD_RES (12)..(12): Hydroxyproline
  MOD_RES (14)..(15): Hydroxyproline
  MOD_RES (16): Hydroxyproline or Leu
SXXXXLSXSXTXTXXXGPH

SEQ ID NO: 115 - protein, 19 aa, Artificial Sequence
  Description of Artificial Sequence: Synthetic amino acid sequence
SPSPTPTAPPGPHSPPPTL

SEQ ID NO: 116 - protein, 38 aa, Artificial Sequence
  Description of Artificial Sequence: Synthetic amino acid sequence
GPHSPPPPLSPSPTPSPPLGPHSPPPTLSPSPTPTPPP

SEQ ID NO: 117 - protein, 19 aa, Artificial Sequence
  Description of Artificial Sequence: Synthetic peptide sequence
TPLPTLTPLPAPTPPLLPH

SEQ ID NO: 118 - protein, 5 aa, Artificial Sequence
  Description of Artificial Sequence: Synthetic peptide
  VARIANT (1): Variable amino acid, preferably Ser or Ala
  MOD_RES (2)..(5): Hydroxyproline
XXXXX

SEQ ID NO: 119 - protein, 5 aa, Artificial Sequence
  Description of Artificial Sequence: Synthetic peptide
  MOD_RES (2)..(5): Hydroxyproline
SXXXX

SEQ ID NO: 120 - protein, 23 aa, Nicotiana tobacum
MASLFATFLVVLSLSLAQTTRSA

SEQ ID NO: 121 - protein, 21 aa, Lycopersicon esculentum
MDRKFVFLVSILCIVVASVTG

SEQ ID NO: 122 - protein, 64 aa, Artificial Sequence
  Description of Artificial Sequence: Synthetic amino acid motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
  MOD_RES (22)..(22): Hydroxyproline
  MOD_RES (24)..(24): Hydroxyproline
  MOD_RES (26)..(26): Hydroxyproline
  MOD_RES (28)..(28): Hydroxyproline
  MOD_RES (30)..(30): Hydroxyproline
  MOD_RES (32)..(32): Hydroxyproline
  MOD_RES (34)..(34): Hydroxyproline
  MOD_RES (36)..(36): Hydroxyproline
  MOD_RES (38)..(38): Hydroxyproline
  MOD_RES (40)..(40): Hydroxyproline
  MOD_RES (42)..(42): Hydroxyproline
  MOD_RES (44)..(44): Hydroxyproline
  MOD_RES (46)..(46): Hydroxyproline
  MOD_RES (48)..(48): Hydroxyproline
  MOD_RES (50)..(50): Hydroxyproline
  MOD_RES (52)..(52): Hydroxyproline
  MOD_RES (54)..(54): Hydroxyproline
  MOD_RES (56)..(56): Hydroxyproline
  MOD_RES (58)..(58): Hydroxyproline
  MOD_RES (60)..(60): Hydroxyproline
  MOD_RES (62)..(62): Hydroxyproline
  MOD_RES (64)..(64): Hydroxyproline
SXSXSXSXSXSXSXSXSXSXSXSXSXSXSXSXSXSXSXSXSXSXSXSXSXSXSXSXSXSXSXSX

SEQ ID NO: 123 - protein, 102 aa, Artificial Sequence
  Description of Artificial Sequence: Synthetic amino acid motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
  MOD_RES (22)..(22): Hydroxyproline
  MOD_RES (24)..(24): Hydroxyproline
  MOD_RES (26)..(26): Hydroxyproline
  MOD_RES (28)..(28): Hydroxyproline
  MOD_RES (30)..(30): Hydroxyproline
  MOD_RES (32)..(32): Hydroxyproline
  MOD_RES (34)..(34): Hydroxyproline
  MOD_RES (36)..(36): Hydroxyproline
  MOD_RES (38)..(38): Hydroxyproline
  MOD_RES (40)..(40): Hydroxyproline
  MOD_RES (42)..(42): Hydroxyproline
  MOD_RES (44)..(44): Hydroxyproline
  MOD_RES (46)..(46): Hydroxyproline
  MOD_RES (48)..(48): Hydroxyproline
  MOD_RES (50)..(50): Hydroxyproline
  MOD_RES (52)..(52): Hydroxyproline
  MOD_RES (54)..(54): Hydroxyproline
  MOD_RES (56)..(56): Hydroxyproline
  MOD_RES (58)..(58): Hydroxyproline
  MOD_RES (60)..(60): Hydroxyproline
  MOD_RES (62)..(62): Hydroxyproline
  MOD_RES (64)..(64): Hydroxyproline
  MOD_RES (66)..(66): Hydroxyproline
  MOD_RES (68)..(68): Hydroxyproline
  MOD_RES (70)..(70): Hydroxyproline
  MOD_RES (72)..(72): Hydroxyproline
  MOD_RES (74)..(74): Hydroxyproline
  MOD_RES (76)..(76): Hydroxyproline
  MOD_RES (78)..(78): Hydroxyproline
  MOD_RES (80)..(80): Hydroxyproline
  MOD_RES (82)..(82): Hydroxyproline
  MOD_RES (84)..(84): Hydroxyproline
  MOD_RES (86)..(86): Hydroxyproline
  MOD_RES (88)..(88): Hydroxyproline
  MOD_RES (90)..(90): Hydroxyproline
  MOD_RES (92)..(92): Hydroxyproline
  MOD_RES (94)..(94): Hydroxyproline
  MOD_RES (96)..(96): Hydroxyproline
  MOD_RES (98)..(98): Hydroxyproline
  MOD_RES (100)..(100): Hydroxyproline
  MOD_RES (102)..(102): Hydroxyproline
AXAXAXAXAXAXAXAXAXAXAXAXAXAXAXAXAXAXAXAXAXAXAXAXAXAXAXAXAXAXAXAXAXAXAXAXAXAXAXAXAXAXAXAXAXAXAXAXAXAXAX

SEQ ID NO: 124 - protein, 198 aa, Artificial Sequence
  Description of Artificial Sequence: Synthetic amino acid motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
  MOD_RES (22)..(22): Hydroxyproline
  MOD_RES (24)..(24): Hydroxyproline
  MOD_RES (26)..(26): Hydroxyproline
  MOD_RES (28)..(28): Hydroxyproline
  MOD_RES (30)..(30): Hydroxyproline
  MOD_RES (32)..(32): Hydroxyproline
  MOD_RES (34)..(34): Hydroxyproline
  MOD_RES (36)..(36): Hydroxyproline
  MOD_RES (38)..(38): Hydroxyproline
  MOD_RES (40)..(40): Hydroxyproline
  MOD_RES (42)..(42): Hydroxyproline
  MOD_RES (44)..(44): Hydroxyproline
  MOD_RES (46)..(46): Hydroxyproline
  MOD_RES (48)..(48): Hydroxyproline
  MOD_RES (50)..(50): Hydroxyproline
  MOD_RES (52)..(52): Hydroxyproline
  MOD_RES (54)..(54): Hydroxyproline
  MOD_RES (56)..(56): Hydroxyproline
  MOD_RES (58)..(58): Hydroxyproline
  MOD_RES (60)..(60): Hydroxyproline
  MOD_RES (62)..(62): Hydroxyproline
  MOD_RES (64)..(64): Hydroxyproline
  MOD_RES (66)..(66): Hydroxyproline
  MOD_RES (68)..(68): Hydroxyproline
  MOD_RES (70)..(70): Hydroxyproline
  MOD_RES (72)..(72): Hydroxyproline
  MOD_RES (74)..(74): Hydroxyproline
  MOD_RES (76)..(76): Hydroxyproline
  MOD_RES (78)..(78): Hydroxyproline
  MOD_RES (80)..(80): Hydroxyproline
  MOD_RES (82)..(82): Hydroxyproline
  MOD_RES (84)..(84): Hydroxyproline
  MOD_RES (86)..(86): Hydroxyproline
  MOD_RES (88)..(88): Hydroxyproline
  MOD_RES (90)..(90): Hydroxyproline
  MOD_RES (92)..(92): Hydroxyproline
  MOD_RES (94)..(94): Hydroxyproline
  MOD_RES (96)..(96): Hydroxyproline
  MOD_RES (98)..(98): Hydroxyproline
  MOD_RES (100)..(100): Hydroxyproline
  MOD_RES (102)..(102): Hydroxyproline
  MOD_RES (104)..(104): Hydroxyproline
  MOD_RES (106)..(106): Hydroxyproline
  MOD_RES (108)..(108): Hydroxyproline
  MOD_RES (110)..(110): Hydroxyproline
  MOD_RES (112)..(112): Hydroxyproline
  MOD_RES (114)..(114): Hydroxyproline
  MOD_RES (116)..(116): Hydroxyproline
  MOD_RES (118)..(118): Hydroxyproline
  MOD_RES (120)..(120): Hydroxyproline
  MOD_RES (122)..(122): Hydroxyproline
  MOD_RES (124)..(124): Hydroxyproline
  MOD_RES (126)..(126): Hydroxyproline
  MOD_RES (128)..(128): Hydroxyproline
  MOD_RES (130)..(130): Hydroxyproline
  MOD_RES (132)..(132): Hydroxyproline
  MOD_RES (134)..(134): Hydroxyproline
  MOD_RES (136)..(136): Hydroxyproline
  MOD_RES (138)..(138): Hydroxyproline
  MOD_RES (140)..(140): Hydroxyproline
  MOD_RES (142)..(142): Hydroxyproline
  MOD_RES (144)..(144): Hydroxyproline
  MOD_RES (146)..(146): Hydroxyproline
  MOD_RES (148)..(148): Hydroxyproline
  MOD_RES (150)..(150): Hydroxyproline
  MOD_RES (152)..(152): Hydroxyproline
  MOD_RES (154)..(154): Hydroxyproline
  MOD_RES (156)..(156): Hydroxyproline
  MOD_RES (158)..(158): Hydroxyproline
  MOD_RES (160)..(160): Hydroxyproline
  MOD_RES (162)..(162): Hydroxyproline
  MOD_RES (164)..(164): Hydroxyproline
  MOD_RES (166)..(166): Hydroxyproline
  MOD_RES (168)..(168): Hydroxyproline
  MOD_RES (170)..(170): Hydroxyproline
  MOD_RES (172)..(172): Hydroxyproline
  MOD_RES (174)..(174): Hydroxyproline
  MOD_RES (176)..(176): Hydroxyproline
  MOD_RES (178)..(178): Hydroxyproline
  MOD_RES (180)..(180): Hydroxyproline
  MOD_RES (182)..(182): Hydroxyproline
  MOD_RES (184)..(184): Hydroxyproline
  MOD_RES (186)..(186): Hydroxyproline
  MOD_RES (188)..(188): Hydroxyproline
  MOD_RES (190)..(190): Hydroxyproline
  MOD_RES (192)..(192): Hydroxyproline
  MOD_RES (194)..(194): Hydroxyproline
  MOD_RES (196)..(196): Hydroxyproline
  MOD_RES (198)..(198): Hydroxyproline
TXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTX

SEQ ID NO: 125 - protein, 20 aa, Artificial Sequence
  Description of Artificial Sequence: Synthetic peptide motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
VXVXVXVXVXVXVXVXVXVX

SEQ ID NO: 126 - protein, 72 aa, Artificial Sequence
  Description of Artificial Sequence: Synthetic amino acid motif
  MOD_RES (2)..(3): Hydroxyproline
  MOD_RES (5)..(6): Hydroxyproline
  MOD_RES (8)..(9): Hydroxyproline
  MOD_RES (11)..(12): Hydroxyproline
  MOD_RES (14)..(15): Hydroxyproline
  MOD_RES (17)..(18): Hydroxyproline
  MOD_RES (20)..(21): Hydroxyproline
  MOD_RES (23)..(24): Hydroxyproline
  MOD_RES (26)..(27): Hydroxyproline
  MOD_RES (29)..(30): Hydroxyproline
  MOD_RES (32)..(33): Hydroxyproline
  MOD_RES (35)..(36): Hydroxyproline
  MOD_RES (38)..(39): Hydroxyproline
  MOD_RES (41)..(42): Hydroxyproline
  MOD_RES (44)..(45): Hydroxyproline
  MOD_RES (47)..(48): Hydroxyproline
  MOD_RES (50)..(51): Hydroxyproline
  MOD_RES (53)..(54): Hydroxyproline
  MOD_RES (56)..(57): Hydroxyproline
  MOD_RES (59)..(60): Hydroxyproline
  MOD_RES (62)..(63): Hydroxyproline
  MOD_RES (65)..(66): Hydroxyproline
  MOD_RES (68)..(69): Hydroxyproline
  MOD_RES (71)..(72): Hydroxyproline
SXXSXXSXXSXXSXXSXXSXXSXXSXXSXXSXXSXXSXXSXXSXXSXXSXXSXXSXXSXXSXXSXXSXXSXX

SEQ ID NO: 127 - protein, 60 aa, Artificial Sequence
  Description of Artificial Sequence: Synthetic amino acid motif
  MOD_RES (2)..(4): Hydroxyproline
  MOD_RES (6)..(8): Hydroxyproline
  MOD_RES (10)..(12): Hydroxyproline
  MOD_RES (14)..(16): Hydroxyproline
  MOD_RES (18)..(20): Hydroxyproline
  MOD_RES (22)..(24): Hydroxyproline
  MOD_RES (26)..(28): Hydroxyproline
  MOD_RES (30)..(32): Hydroxyproline
  MOD_RES (34)..(36): Hydroxyproline
  MOD_RES (38)..(40): Hydroxyproline
  MOD_RES (42)..(44): Hydroxyproline
  MOD_RES (46)..(48): Hydroxyproline
  MOD_RES (50)..(52): Hydroxyproline
  MOD_RES (54)..(56): Hydroxyproline
  MOD_RES (58)..(60): Hydroxyproline
SXXXSXXXSXXXSXXXSXXXSXXXSXXXSXXXSXXXSXXXSXXXSXXXSXXXSXXXSXXX

SEQ ID NO: 128 - protein, 90 aa, Artificial Sequence
  Description of Artificial Sequence: Synthetic amino acid motif
  MOD_RES (2)..(5): Hydroxyproline
  MOD_RES (7)..(10): Hydroxyproline
  MOD_RES (12)..(15): Hydroxyproline
  MOD_RES (17)..(20): Hydroxyproline
  MOD_RES (22)..(25): Hydroxyproline
  MOD_RES (27)..(30): Hydroxyproline
  MOD_RES (32)..(35): Hydroxyproline
  MOD_RES (37)..(40): Hydroxyproline
  MOD_RES (42)..(45): Hydroxyproline
  MOD_RES (47)..(50): Hydroxyproline
  MOD_RES (52)..(55): Hydroxyproline
  MOD_RES (57)..(60): Hydroxyproline
  MOD_RES (62)..(65): Hydroxyproline
  MOD_RES (67)..(70): Hydroxyproline
  MOD_RES (72)..(75): Hydroxyproline
  MOD_RES (77)..(80): Hydroxyproline
  MOD_RES (82)..(85): Hydroxyproline
  MOD_RES (87)..(90): Hydroxyproline
SXXXXSXXXXSXXXXSXXXXSXXXXSXXXXSXXXXSXXXXSXXXXSXXXXSXXXXSXXXXSXXXXSXXXXSXXXXSXXXXSXXXXSXXXX

SEQ ID NO: 129 - protein, 328 aa, Artificial Sequence
  Description of Artificial Sequence: Synthetic amino acid motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(13): Hydroxyproline
  MOD_RES (15)..(15): Hydroxyproline
  MOD_RES (17)..(20): Hydroxyproline
  MOD_RES (26)..(29): Hydroxyproline
  MOD_RES (31)..(31): Hydroxyproline
  MOD_RES (33)..(36): Hydroxyproline
  MOD_RES (42)..(45): Hydroxyproline
  MOD_RES (47)..(47): Hydroxyproline
  MOD_RES (49)..(52): Hydroxyproline
  MOD_RES (58)..(61): Hydroxyproline
  MOD_RES (63)..(63): Hydroxyproline
  MOD_RES (65)..(68): Hydroxyproline
  MOD_RES (74)..(77): Hydroxyproline
  MOD_RES (79)..(79): Hydroxyproline
  MOD_RES (81)..(84): Hydroxyproline
  MOD_RES (90)..(93): Hydroxyproline
  MOD_RES (95)..(95): Hydroxyproline
  MOD_RES (97)..(100): Hydroxyproline
  MOD_RES (106)..(109): Hydroxyproline
  MOD_RES (111)..(111): Hydroxyproline
  MOD_RES (113)..(116): Hydroxyproline
  MOD_RES (122)..(125): Hydroxyproline
  MOD_RES (127)..(127): Hydroxyproline
  MOD_RES (129)..(132): Hydroxyproline
  MOD_RES (138)..(141): Hydroxyproline
  MOD_RES (143)..(143): Hydroxyproline
  MOD_RES (145)..(148): Hydroxyproline
  MOD_RES (154)..(157): Hydroxyproline
  MOD_RES (159)..(159): Hydroxyproline
  MOD_RES (161)..(164): Hydroxyproline
  MOD_RES (170)..(173): Hydroxyproline
  MOD_RES (175)..(175): Hydroxyproline
  MOD_RES (177)..(180): Hydroxyproline
  MOD_RES (186)..(189): Hydroxyproline
  MOD_RES (191)..(191): Hydroxyproline
  MOD_RES (193)..(196): Hydroxyproline
  MOD_RES (202)..(205): Hydroxyproline
  MOD_RES (207)..(207): Hydroxyproline
  MOD_RES (209)..(212): Hydroxyproline
  MOD_RES (218)..(221): Hydroxyproline
  MOD_RES (223)..(223): Hydroxyproline
  MOD_RES (225)..(228): Hydroxyproline
  MOD_RES (234)..(237): Hydroxyproline
  MOD_RES (239)..(239): Hydroxyproline
  MOD_RES (241)..(244): Hydroxyproline
  MOD_RES (250)..(253): Hydroxyproline
  MOD_RES (255)..(255): Hydroxyproline
  MOD_RES (257)..(260): Hydroxyproline
  MOD_RES (266)..(269): Hydroxyproline
  MOD_RES (271)..(271): Hydroxyproline
  MOD_RES (273)..(276): Hydroxyproline
  MOD_RES (282)..(285): Hydroxyproline
  MOD_RES (287)..(287): Hydroxyproline
  MOD_RES (289)..(292): Hydroxyproline
  MOD_RES (298)..(301): Hydroxyproline
  MOD_RES (303)..(303): Hydroxyproline
  MOD_RES (305)..(308): Hydroxyproline
  MOD_RES (314)..(317): Hydroxyproline
  MOD_RES (319)..(319): Hydroxyproline
  MOD_RES (321)..(324): Hydroxyproline
AXAXAXAXSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYK

SEQ ID NO: 130 - protein, 42 aa, Artificial Sequence
  Description of Artificial Sequence: Synthetic amino acid motif
  MOD_RES (5)..(6): Hydroxyproline
  MOD_RES (12)..(13): Hydroxyproline
  MOD_RES (19)..(20): Hydroxyproline
  MOD_RES (26)..(27): Hydroxyproline
  MOD_RES (33)..(34): Hydroxyproline
  MOD_RES (40)..(41): Hydroxyproline
AASSXXLAASSXXLAASSXXLAASSXXLAASSXXLAASSXXL

SEQ ID NO: 131 - protein, 42 aa, Artificial Sequence
  Description of Artificial Sequence: Synthetic amino acid motif
  MOD_RES (6)..(7): Hydroxyproline
  MOD_RES (13)..(14): Hydroxyproline
  MOD_RES (20)..(21): Hydroxyproline
  MOD_RES (27)..(28): Hydroxyproline
  MOD_RES (34)..(35): Hydroxyproline
  MOD_RES (41)..(42): Hydroxyproline
AAGTTXXAAGTTXXAAGTTXXAAGTTXXAAGTTXXAAGTTXX

SEQ ID NO: 132 - protein, 320 aa, Artificial Sequence
  Description of Artificial Sequence: Synthetic amino acid motif
  MOD_RES (2)..(5): Hydroxyproline
  MOD_RES (7)..(7): Hydroxyproline
  MOD_RES (9)..(12): Hydroxyproline
  MOD_RES (18)..(21): Hydroxyproline
  MOD_RES (23)..(23): Hydroxyproline
  MOD_RES (25)..(28): Hydroxyproline
  MOD_RES (34)..(37): Hydroxyproline
  MOD_RES (39)..(39): Hydroxyproline
  MOD_RES (41)..(44): Hydroxyproline
  MOD_RES (50)..(53): Hydroxyproline
  MOD_RES (55)..(55): Hydroxyproline
  MOD_RES (57)..(60): Hydroxyproline
  MOD_RES (66)..(69): Hydroxyproline
  MOD_RES (71)..(71): Hydroxyproline
  MOD_RES (73)..(76): Hydroxyproline
  MOD_RES (82)..(85): Hydroxyproline
  MOD_RES (87)..(87): Hydroxyproline
  MOD_RES (89)..(92): Hydroxyproline
  MOD_RES (98)..(101): Hydroxyproline
  MOD_RES (103)..(103): Hydroxyproline
  MOD_RES (105)..(108): Hydroxyproline
  MOD_RES (114)..(117): Hydroxyproline
  MOD_RES (119)..(119): Hydroxyproline
  MOD_RES (121)..(124): Hydroxyproline
  MOD_RES (130)..(133): Hydroxyproline
  MOD_RES (135)..(135): Hydroxyproline
  MOD_RES (137)..(140): Hydroxyproline
  MOD_RES (146)..(149): Hydroxyproline
  MOD_RES (151)..(151): Hydroxyproline
  MOD_RES (153)..(156): Hydroxyproline
  MOD_RES (162)..(165): Hydroxyproline
  MOD_RES (167)..(167): Hydroxyproline
  MOD_RES (169)..(172): Hydroxyproline
  MOD_RES (178)..(181): Hydroxyproline
  MOD_RES (183)..(183): Hydroxyproline
  MOD_RES (185)..(188): Hydroxyproline
  MOD_RES (194)..(197): Hydroxyproline
  MOD_RES (199)..(199): Hydroxyproline
  MOD_RES (201)..(204): Hydroxyproline
  MOD_RES (210)..(213): Hydroxyproline
  MOD_RES (215)..(215): Hydroxyproline
  MOD_RES (217)..(220): Hydroxyproline
  MOD_RES (226)..(229): Hydroxyproline
  MOD_RES (231)..(231): Hydroxyproline
  MOD_RES (233)..(236): Hydroxyproline
  MOD_RES (242)..(245): Hydroxyproline
  MOD_RES (247)..(247): Hydroxyproline
  MOD_RES (249)..(252): Hydroxyproline
  MOD_RES (258)..(261): Hydroxyproline
  MOD_RES (263)..(263): Hydroxyproline
  MOD_RES (265)..(268): Hydroxyproline
  MOD_RES (274)..(277): Hydroxyproline
  MOD_RES (279)..(279): Hydroxyproline
  MOD_RES (281)..(284): Hydroxyproline
  MOD_RES (290)..(293): Hydroxyproline
  MOD_RES (295)..(295): Hydroxyproline
  MOD_RES (297)..(300): Hydroxyproline
  MOD_RES (306)..(309): Hydroxyproline
  MOD_RES (311)..(311): Hydroxyproline
  MOD_RES (313)..(316): Hydroxyproline
SXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYK

SEQ ID NO: 133 - protein, 128 aa, Artificial Sequence
  Description of Artificial Sequence: Synthetic amino acid motif
  MOD_RES (2)..(5): Hydroxyproline
  MOD_RES (7)..(7): Hydroxyproline
  MOD_RES (9)..(12): Hydroxyproline
  MOD_RES (18)..(21): Hydroxyproline
  MOD_RES (23)..(23): Hydroxyproline
  MOD_RES (25)..(28): Hydroxyproline
  MOD_RES (34)..(37): Hydroxyproline
  MOD_RES (39)..(39): Hydroxyproline
  MOD_RES (41)..(44): Hydroxyproline
  MOD_RES (50)..(53): Hydroxyproline
  MOD_RES (55)..(55): Hydroxyproline
  MOD_RES (57)..(60): Hydroxyproline
  MOD_RES (66)..(69): Hydroxyproline
  MOD_RES (71)..(71): Hydroxyproline
  MOD_RES (73)..(76): Hydroxyproline
  MOD_RES (82)..(85): Hydroxyproline
  MOD_RES (87)..(87): Hydroxyproline
  MOD_RES (89)..(92): Hydroxyproline
  MOD_RES (98)..(101): Hydroxyproline
  MOD_RES (103)..(103): Hydroxyproline
  MOD_RES (105)..(108): Hydroxyproline
  MOD_RES (114)..(117): Hydroxyproline
  MOD_RES (119)..(119): Hydroxyproline
  MOD_RES (121)..(124): Hydroxyproline
SXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYKSXXXXSXSXXXXYYYK

SEQ ID NO: 134 - protein, 128 aa, Artificial Sequence
  Description of Artificial Sequence: Synthetic amino acid motif
  MOD_RES (2)..(5): Hydroxyproline
  MOD_RES (7)..(7): Hydroxyproline
  MOD_RES (9)..(12): Hydroxyproline
  MOD_RES (18)..(21): Hydroxyproline
  MOD_RES (23)..(23): Hydroxyproline
  MOD_RES (25)..(28): Hydroxyproline
  MOD_RES (34)..(37): Hydroxyproline
  MOD_RES (39)..(39): Hydroxyproline
  MOD_RES (41)..(44): Hydroxyproline
  MOD_RES (50)..(53): Hydroxyproline
  MOD_RES (55)..(55): Hydroxyproline
  MOD_RES (57)..(60): Hydroxyproline
  MOD_RES (66)..(69): Hydroxyproline
  MOD_RES (71)..(71): Hydroxyproline
  MOD_RES (73)..(76): Hydroxyproline
  MOD_RES (82)..(85): Hydroxyproline
  MOD_RES (87)..(87): Hydroxyproline
  MOD_RES (89)..(92): Hydroxyproline
  MOD_RES (98)..(101): Hydroxyproline
  MOD_RES (103)..(103): Hydroxyproline
  MOD_RES (105)..(108): Hydroxyproline
  MOD_RES (114)..(117): Hydroxyproline
  MOD_RES (119)..(119): Hydroxyproline
  MOD_RES (121)..(124): Hydroxyproline
SXXXXSXSXXXXYYYLSXXXXSXSXXXXYYYLSXXXXSXSXXXXYYYLSXXXXSXSXXXXYYYLSXXXXSXSXXXXYYYLSXXXXSXSXXXXYYYLSXXXXSXSXXXXYYYLSXXXXSXSXXXXYYYL

SEQ ID NO: 135 - protein, 128 aa, Artificial Sequence
  Description of Artificial Sequence: Synthetic amino acid motif
  MOD_RES (2)..(5): Hydroxyproline
  MOD_RES (7)..(7): Hydroxyproline
  MOD_RES (9)..(12): Hydroxyproline
  MOD_RES (18)..(21): Hydroxyproline
  MOD_RES (23)..(23): Hydroxyproline
  MOD_RES (25)..(28): Hydroxyproline
  MOD_RES (34)..(37): Hydroxyproline
  MOD_RES (39)..(39): Hydroxyproline
  MOD_RES (41)..(44): Hydroxyproline
  MOD_RES (50)..(53): Hydroxyproline
  MOD_RES (55)..(55): Hydroxyproline
  MOD_RES (57)..(60): Hydroxyproline
  MOD_RES (66)..(69): Hydroxyproline
  MOD_RES (71)..(71): Hydroxyproline
  MOD_RES (73)..(76): Hydroxyproline
  MOD_RES (82)..(85): Hydroxyproline
  MOD_RES (87)..(87): Hydroxyproline
  MOD_RES (89)..(92): Hydroxyproline
  MOD_RES (98)..(101): Hydroxyproline
  MOD_RES (103)..(103): Hydroxyproline
  MOD_RES (105)..(108): Hydroxyproline
  MOD_RES (114)..(117): Hydroxyproline
  MOD_RES (119)..(119): Hydroxyproline
  MOD_RES (121)..(124): Hydroxyproline
SXXXXSXSXXXXFFFKSXXXXSXSXXXXFFFKSXXXXSXSXXXXFFFKSXXXXSXSXXXXFFFKSXXXXSXSXXXXFFFKSXXXXSXSXXXXFFFKSXXXXSXSXXXXFFFKSXXXXSXSXXXXFFFK

SEQ ID NO: 136 - protein, 4 aa, Artificial Sequence
  Description of Artificial Sequence: Synthetic peptide
  MOD_RES (2): Hydroxyproline
  MOD_RES (4): Hydroxyproline
SXSX

SEQ ID NO: 137 - DNA, 33 bp, Artificial Sequence
  Description of Artificial Sequence: Synthetic primer
ataaggcccgggtaggcgatggggaagggcttg

SEQ ID NO: 138 - DNA, 33 bp, Artificial Sequence
  Description of Artificial Sequence: Synthetic primer
taagtgtacaatcagggtgagaagccgcagctg

SEQ ID NO: 139 - DNA, 26 bp, Artificial Sequence
  Description of Artificial Sequence: Synthetic primer
agaggatccgcaatgggaaaaatggc

SEQ ID NO: 140 - DNA, 32 bp, Artificial Sequence
  Description of Artificial Sequence: Synthetic primer
taagtgtacaatcatggagagggtgagaagcc

SEQ ID NO: 141 - DNA, 35 bp, Artificial Sequence
  Description of Artificial Sequence: Synthetic primer
taagtgtacaatcaaggcgatggggaagggcttgg

SEQ ID NO: 142 - DNA, 33 bp, Artificial Sequence
  Description of Artificial Sequence: Synthetic primer
ataagccatggttgggctgggagaaggggatgg

SEQ ID NO: 143 - protein, 10 aa, Artificial Sequence
  Description of Artificial Sequence: Synthetic peptide motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
SXSXSXSXSX

SEQ ID NO: 144 - protein, 40 aa, Artificial Sequence; identical to SEQ ID NO: 113
  Description of Artificial Sequence: Synthetic peptide motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
  MOD_RES (22)..(22): Hydroxyproline
  MOD_RES (24)..(24): Hydroxyproline
  MOD_RES (26)..(26): Hydroxyproline
  MOD_RES (28)..(28): Hydroxyproline
  MOD_RES (30)..(30): Hydroxyproline
  MOD_RES (32)..(32): Hydroxyproline
  MOD_RES (34)..(34): Hydroxyproline
  MOD_RES (36)..(36): Hydroxyproline
  MOD_RES (38)..(38): Hydroxyproline
  MOD_RES (40)..(40): Hydroxyproline

SEQ ID NO: 145 - DNA, 33 bp, Artificial Sequence
  Description of Artificial Sequence: Synthetic primer
ttatcccgggcctcaccctctccaagcccttcc

SEQ ID NO: 146 - DNA, 31 bp, Artificial Sequence
  Description of Artificial Sequence: Synthetic primer
ttatcccgggtgggctgggagaaggggatgg

SEQ ID NO: 147 - DNA, 28 bp, Artificial Sequence
  Description of Artificial Sequence: Synthetic primer
ggacctagaggaaaagatccaaacgctg

SEQ ID NO: 148 - DNA, 28 bp, Artificial Sequence
  Description of Artificial Sequence: Synthetic primer
cagcgtttggatcttttcctctaggtcc

SEQ ID NO: 149 - protein, 22 aa, Artificial Sequence
  Description of Artificial Sequence: Synthetic peptide motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
  MOD_RES (22)..(22): Hydroxyproline
AXAXAXAXAXAXAXAXAXAXAX

SEQ ID NO: 150 - protein, 22 aa, Artificial Sequence
  Description of Artificial Sequence: Synthetic peptide motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
  MOD_RES (22)..(22): Hydroxyproline
TXTXTXTXTXTXTXTXTXTXTX

SEQ ID NO: 151 - protein, 202 aa, Artificial Sequence
  Description of Artificial Sequence: Synthetic amino acid motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
  MOD_RES (22)..(22): Hydroxyproline
  MOD_RES (24)..(24): Hydroxyproline
  MOD_RES (26)..(26): Hydroxyproline
  MOD_RES (28)..(28): Hydroxyproline
  MOD_RES (30)..(30): Hydroxyproline
  MOD_RES (32)..(32): Hydroxyproline
  MOD_RES (34)..(34): Hydroxyproline
  MOD_RES (36)..(36): Hydroxyproline
  MOD_RES (38)..(38): Hydroxyproline
  MOD_RES (40)..(40): Hydroxyproline
  MOD_RES (42)..(42): Hydroxyproline
  MOD_RES (44)..(44): Hydroxyproline
  MOD_RES (46)..(46): Hydroxyproline
  MOD_RES (48)..(48): Hydroxyproline
  MOD_RES (50)..(50): Hydroxyproline
  MOD_RES (52)..(52): Hydroxyproline
  MOD_RES (54)..(54): Hydroxyproline
  MOD_RES (56)..(56): Hydroxyproline
  MOD_RES (58)..(58): Hydroxyproline
  MOD_RES (60)..(60): Hydroxyproline
  MOD_RES (62)..(62): Hydroxyproline
  MOD_RES (64)..(64): Hydroxyproline
  MOD_RES (66)..(66): Hydroxyproline
  MOD_RES (68)..(68): Hydroxyproline
  MOD_RES (70)..(70): Hydroxyproline
  MOD_RES (72)..(72): Hydroxyproline
  MOD_RES (74)..(74): Hydroxyproline
  MOD_RES (76)..(76): Hydroxyproline
  MOD_RES (78)..(78): Hydroxyproline
  MOD_RES (80)..(80): Hydroxyproline
  MOD_RES (82)..(82): Hydroxyproline
  MOD_RES (84)..(84): Hydroxyproline
  MOD_RES (86)..(86): Hydroxyproline
  MOD_RES (88)..(88): Hydroxyproline
  MOD_RES (90)..(90): Hydroxyproline
  MOD_RES (92)..(92): Hydroxyproline
  MOD_RES (94)..(94): Hydroxyproline
  MOD_RES (96)..(96): Hydroxyproline
  MOD_RES (98)..(98): Hydroxyproline
  MOD_RES (100)..(100): Hydroxyproline
  MOD_RES (102)..(102): Hydroxyproline
  MOD_RES (104)..(104): Hydroxyproline
  MOD_RES (106)..(106): Hydroxyproline
  MOD_RES (108)..(108): Hydroxyproline
  MOD_RES (110)..(110): Hydroxyproline
  MOD_RES (112)..(112): Hydroxyproline
  MOD_RES (114)..(114): Hydroxyproline
  MOD_RES (116)..(116): Hydroxyproline
  MOD_RES (118)..(118): Hydroxyproline
  MOD_RES (120)..(120): Hydroxyproline
  MOD_RES (122)..(122): Hydroxyproline
  MOD_RES (124)..(124): Hydroxyproline
  MOD_RES (126)..(126): Hydroxyproline
  MOD_RES (128)..(128): Hydroxyproline
  MOD_RES (130)..(130): Hydroxyproline
  MOD_RES (132)..(132): Hydroxyproline
  MOD_RES (134)..(134): Hydroxyproline
  MOD_RES (136)..(136): Hydroxyproline
  MOD_RES (138)..(138): Hydroxyproline
  MOD_RES (140)..(140): Hydroxyproline
  MOD_RES (142)..(142): Hydroxyproline
  MOD_RES (144)..(144): Hydroxyproline
  MOD_RES (146)..(146): Hydroxyproline
  MOD_RES (148)..(148): Hydroxyproline
  MOD_RES (150)..(150): Hydroxyproline
  MOD_RES (152)..(152): Hydroxyproline
  MOD_RES (154)..(154): Hydroxyproline
  MOD_RES (156)..(156): Hydroxyproline
  MOD_RES (158)..(158): Hydroxyproline
  MOD_RES (160)..(160): Hydroxyproline
  MOD_RES (162)..(162): Hydroxyproline
  MOD_RES (164)..(164): Hydroxyproline
  MOD_RES (166)..(166): Hydroxyproline
  MOD_RES (168)..(168): Hydroxyproline
  MOD_RES (170)..(170): Hydroxyproline
  MOD_RES (172)..(172): Hydroxyproline
  MOD_RES (174)..(174): Hydroxyproline
  MOD_RES (176)..(176): Hydroxyproline
  MOD_RES (178)..(178): Hydroxyproline
  MOD_RES (180)..(180): Hydroxyproline
  MOD_RES (182)..(182): Hydroxyproline
  MOD_RES (184)..(184): Hydroxyproline
  MOD_RES (186)..(186): Hydroxyproline
  MOD_RES (188)..(188): Hydroxyproline
  MOD_RES (190)..(190): Hydroxyproline
  MOD_RES (192)..(192): Hydroxyproline
  MOD_RES (194)..(194): Hydroxyproline
  MOD_RES (196)..(196): Hydroxyproline
  MOD_RES (198)..(198): Hydroxyproline
  MOD_RES (200)..(200): Hydroxyproline
  MOD_RES (202)..(202): Hydroxyproline
TXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTXTX

SEQ ID NO: 152 - protein, 22 aa, Artificial Sequence
  Description of Artificial Sequence: Synthetic peptide motif
  MOD_RES (2)..(2): Hydroxyproline
  MOD_RES (4)..(4): Hydroxyproline
  MOD_RES (6)..(6): Hydroxyproline
  MOD_RES (8)..(8): Hydroxyproline
  MOD_RES (10)..(10): Hydroxyproline
  MOD_RES (12)..(12): Hydroxyproline
  MOD_RES (14)..(14): Hydroxyproline
  MOD_RES (16)..(16): Hydroxyproline
  MOD_RES (18)..(18): Hydroxyproline
  MOD_RES (20)..(20): Hydroxyproline
  MOD_RES (22)..(22): Hydroxyproline
VXVXVXVXVXVXVXVXVXVXVX

SEQ ID NO: 153 - DNA, 30 bp, Artificial Sequence
  Description of Artificial Sequence: Synthetic primer
acccgggccttcccaaccattcccttatcc

SEQ ID NO: 154 - protein, 15 aa, Artificial Sequence
  Description of Artificial Sequence: Synthetic peptide sequence
FPTIPLSRLFDNAML

SEQ ID NO: 155 - protein, 15 aa, Artificial Sequence
  Description of Artificial Sequence: Synthetic peptide sequence
SHNDDALLKNYGLLY

SEQ ID NO: 156 - protein, 1001 aa, Artificial Sequence; identical to SEQ ID NO: 2
  Description of Artificial Sequence: Synthetic amino acid motif
  MOD_RES (1)..(1000): This region encompasses at least 2 to 1,000 residues of Hydroxyproline, and subject to having the minumum number of residues, any one or more of amino acid residues at positions 1 to 1,000 can either be present or absent
  MOD_RES (1001): Lys, Ser, Ala, Thr, Gly, or Val

SEQ ID NO: 157 - protein, 2000 aa, Artificial Sequence; identical to SEQ ID NO: 3
  Description of Artificial Sequence: Synthetic amino acid motif
  MOD_RES (1): Hydroxyproline
  VARIANT (2): Lys, Ser, Ala, Thr, Gly, or Val
  MOD_RES (3): Hydroxyproline
  VARIANT (4): Lys, Ser, Ala, Thr, Gly, or Val
  MOD_RES (5): Hydroxyproline
  VARIANT (6): Lys, Ser, Ala, Thr, Gly, or Val
  MOD_RES (7): Hydroxyproline
  VARIANT (8): Lys, Ser, Ala, Thr, Gly, or Val
  MOD_RES (9): Hydroxyproline
  VARIANT (10): Lys, Ser, Ala, Thr, Gly, or Val
  MOD_RES (11): Hydroxyproline
  VARIANT (12): Lys, Ser, Ala, Thr, Gly, or Val
  MOD_RES (13): Hydroxyproline
  VARIANT (14): Lys, Ser, Ala, Thr, Gly, or Val
  MOD_RES (15): Hydroxyproline
  VARIANT (16): Lys, Ser, Ala, Thr, Gly, or Val
  MOD_RES (17): Hydroxyproline
  VARIANT (18): Lys, Ser, Ala, Thr, Gly, or Val
  MOD_RES (19): Hydroxyproline
  VARIANT (20): Lys, Ser, Ala, Thr, Gly, or Val
  MOD_RES (21): Hydroxyproline
  VARIANT (22): Lys, Ser, Ala, Thr, Gly, or Val
  MOD_RES (23): Hydroxyproline
  VARIANT (24): Lys, Ser, Ala, Thr, Gly, or Val
  MOD_RES (25): Hydroxyproline
  VARIANT (26): Lys, Ser, Ala, Thr, Gly, or Val
  MOD_RES (27): Hydroxyproline
  VARIANT (28): Lys, Ser, Ala, Thr, Gly, or Val
  MOD_RES (29): Hydroxyproline
  VARIANT (30): Lys, Ser, Ala, Thr, Gly, or Val
  MOD_RES (31): Hydroxyproline
  VARIANT (32): Lys, Ser, Ala, Thr, Gly, or Val
  MOD_RES (33): Hydroxyproline
  VARIANT (34): Lys, Ser, Ala, Thr, Gly, or Val
  MOD_RES (35): Hydroxyproline
  VARIANT (36): Lys, Ser, Ala, Thr, Gly, or Val
  MOD_RES (37): Hydroxyproline
  VARIANT (38): Lys, Ser, Ala, Thr, Gly, or Val
  MOD_RES (39): Hydroxyproline
  VARIANT (40): Lys, Ser, Ala, Thr, Gly, or Val
  MOD_RES (41): Hydroxyproline
  VARIANT (42): Lys, Ser, Ala, Thr, Gly, or Val
  MOD_RES (43): Hydroxyproline
  VARIANT (44): Lys, Ser, Ala, Thr, Gly, or Val
  MOD_RES (45): Hydroxyproline
  VARIANT (46): Lys, Ser, Ala, Thr, Gly, or Val
  MOD_RES (47): Hydroxyproline
  VARIANT (48): Lys, Ser, Ala, Thr, Gly, or Val
  MOD_RES (49): Hydroxyproline
  VARIANT (50): Lys, Ser, Ala, Thr, Gly, or Val
  MOD_RES (51): Hydroxyproline
  VARIANT (52): Lys, Ser, Ala, Thr, Gly, or Val
  MOD_RES (53): Hydroxyproline
  VARIANT (54): Lys, Ser, Ala, Thr, Gly, or Val
  MOD_RES (55): Hydroxyproline
  VARIANT (56): Lys, Ser, Ala, Thr, Gly, or Val
  MOD_RES (57): Hydroxyproline
  VARIANT (58): Lys, Ser, Ala, Thr, Gly, or Val
  MOD_RES (59): Hydroxyproline
  VARIANT (60): Lys, Ser, Ala, Thr, Gly, or Val
  MOD_RES (61): Hydroxyproline
  VARIANT (62): Lys, Ser, Ala, Thr, Gly, or Val
  MOD_RES (63): Hydroxyproline
  VARIANT (64): Lys, Ser, Ala, Thr, Gly, or Val
  MOD_RES (65): Hydroxyproline
  VARIANT (66): Lys, Ser, Ala, Thr, Gly, or Val
  MOD_RES (67): Hydroxyproline
  VARIANT (68): Lys, Ser, Ala, Thr, Gly, or Val
  MOD_RES (69): Hydroxyproline
  VARIANT (70): Lys, Ser, Ala, Thr, Gly, or Val
  MOD_RES (71): Hydroxyproline
  VARIANT (72): Lys, Ser, Ala, Thr, Gly, or Val
  MOD_RES (73): Hydroxyproline
  VARIANT (74): Lys, Ser, Ala, Thr, Gly, or Val
  MOD_RES (75): Hydroxyproline
  VARIANT (76): Lys, Ser, Ala, Thr, Gly, or Val
  MOD_RES (77): Hydroxyproline
  VARIANT (78): Lys, Ser, Ala, Thr, Gly, or Val
  MOD_RES (79): Hydroxyproline
  VARIANT (80): Lys, Ser, Ala, Thr, Gly, or Val
  MOD_RES (81): Hydroxyproline
  VARIANT (82): Lys, Ser, Ala, Thr, Gly, or Val
  MOD_RES (83): Hydroxyproline
  VARIANT (84): Lys, Ser, Ala, Thr, Gly, or Val
  MOD_RES (85): Hydroxyproline
  VARIANT (86): Lys, Ser, Ala, Thr, Gly, or Val
  MOD_RES (87): Hydroxyproline
  VARIANT (88): Lys, Ser, Ala, Thr, Gly, or Val
  MOD_RES (89): Hydroxyproline
  VARIANT (90): Lys, Ser, Ala, Thr, Gly, or Val
  MOD_RES (91): Hydroxyproline
  VARIANT (92): Lys, Ser, Ala, Thr, Gly, or Val
  MOD_RES (93): Hydroxyproline
  VARIANT (94): Lys, Ser, Ala, Thr, Gly, or Val
  MOD_RES (95): Hydroxyproline
  VARIANT (96): Lys, Ser, Ala, Thr, Gly, or Val
  MOD_RES (97): Hydroxyproline
  VARIANT (98): Lys, Ser, Ala, Thr, Gly, or Val
  MOD_RES (99): Hydroxyproline
  VARIANT (100): Lys, Ser, Ala, Thr, Gly, or Val
  MOD_RES (101): Hydroxyproline
  VARIANT (102): Lys, Ser, Ala, Thr, Gly, or Val
  MOD_RES (103): Hydroxyproline
  VARIANT (104): Lys, Ser, Ala, Thr, Gly, or Val
  MOD_RES (105): Hydroxyproline
  VARIANT (106): Lys, Ser, Ala, Thr, Gly, or Val
  MOD_RES (107): Hydroxyproline
  VARIANT (108): Lys, Ser, Ala, Thr, Gly, or Val
  MOD_RES (109): Hydroxyproline
  VARIANT (110): Lys, Ser, Ala, Thr, Gly, or Val
  MOD_RES (111): Hydroxyproline
  VARIANT (112): Lys, Ser, Ala, Thr, Gly, or Val
  MOD_RES (113): Hydroxyproline
  VARIANT (114): Lys, Ser, Ala, Thr, Gly, or Val
  MOD_RES (115): Hydroxyproline
  VARIANT (116): Lys, Ser, Ala, Thr, Gly, or Val
  MOD_RES (117): Hydroxyproline
  VARIANT (118): Lys, Ser, Ala, Thr, Gly, or Val
  MOD_RES (119): Hydroxyproline
  VARIANT (120): Lys, Ser, Ala, Thr, Gly, or Val
  MOD_RES (121): Hydroxyproline
  VARIANT (122): Lys, Ser, Ala, Thr, Gly, or Val
  MOD_RES (123): Hydroxyproline
  VARIANT (124): Lys, Ser, Ala, Thr, Gly, or Val
  MOD_RES (125): Hydroxyproline
  VARIANT (126): Lys, Ser, Ala, Thr, Gly, or Val
  MOD_RES (127): Hydroxyproline
  VARIANT (128): Lys, Ser, Ala, Thr, Gly, or Val
  MOD_RES (129): Hydroxyproline
  VARIANT (130): Lys, Ser, Ala, Thr, Gly, or Val
  MOD_RES (131): Hydroxyproline
  VARIANT (132): Lys, Ser, Ala, Thr, Gly, or Val
  MOD_RES (133): Hydroxyproline
  VARIANT (134): Lys, Ser, Ala, Thr, Gly, or Val
  MOD_RES (135): Hydroxyproline
  VARIANT (136): Lys, Ser, Ala, Thr, Gly, or Val
  MOD_RES (137): Hydroxyproline
  VARIANT (138): Lys, Ser, Ala, Thr, Gly, or Val
  MOD_RES (139): Hydroxyproline
  VARIANT (140): Lys, Ser, Ala, Thr, Gly, or Val
  MOD_RES (141): Hydroxyproline
  VARIANT (142): Lys, Ser, Ala, Thr, Gly, or Val
  MOD_RES (143): Hydroxyproline
  VARIANT (144): Lys, Ser, Ala, Thr, Gly, or Val
  MOD_RES (145): Hydroxyproline
  VARIANT (146): Lys, Ser, Ala, Thr, Gly, or Val
  MOD_RES (147): Hydroxyproline
  VARIANT (148): Lys, Ser, Ala, Thr, Gly, or Val
  MOD_RES (149): Hydroxyproline
  VARIANT (150): Lys, Ser, Ala, Thr, Gly, or Val
  MOD_RES (151): Hydroxyproline
  VARIANT (152): Lys, Ser, Ala, Thr, Gly, or Val
  MOD_RES (153): Hydroxyproline
  VARIANT (154): Lys, Ser, Ala, Thr, Gly, or Val
  MOD_RES (155): Hydroxyproline
  VARIANT (156): Lys, Ser, Ala, Thr, Gly, or Val
  MOD_RES (157): Hydroxyproline
  VARIANT (158): Lys, Ser, Ala, Thr, Gly, or Val
  MOD_RES (159): Hydroxyproline
  VARIANT (160): Lys, Ser, Ala, Thr, Gly, or Val
  MOD_RES (161): Hydroxyproline
  VARIANT (162): Lys, Ser, Ala, Thr, Gly, or Val
  MOD_RES (163): Hydroxyproline
  VARIANT (164): Lys, Ser, Ala, Thr, Gly, or Val
  MOD_RES (165): Hydroxyproline
  VARIANT (166): Lys, Ser, Ala, Thr, Gly, or Val
  MOD_RES (167): Hydroxyproline
  VARIANT (168): Lys, Ser, Ala, Thr, Gly, or Val
  MOD_RES (169): Hydroxyproline
  VARIANT (170): Lys, Ser, Ala, Thr, Gly, or Val
  MOD_RES (171): Hydroxyproline
  VARIANT (172): Lys, Ser, Ala, Thr, Gly, or Val
  MOD_RES (173): Hydroxyproline
  VARIANT (174): Lys, Ser, Ala, Thr, Gly, or Val
  MOD_RES (175): Hydroxyproline
  VARIANT (176): Lys, Ser, Ala, Thr, Gly, or Val
  MOD_RES (177): Hydroxyproline
  VARIANT (178): Lys, Ser, Ala, Thr, Gly, or Val
  MOD_RES (179): Hydroxyproline
  VARIANT (180): Lys, Ser, Ala, Thr, Gly, or Val
  MOD_RES (181): Hydroxyproline
  VARIANT (182): Lys, Ser, Ala, Thr, Gly, or Val
  MOD_RES (183): Hydroxyproline
  VARIANT (184): Lys, Ser, Ala, Thr, Gly, or Val
  MOD_RES (185): Hydroxyproline
  VARIANT (186): Lys, Ser, Ala, Thr, Gly, or Val
  MOD_RES (187): Hydroxyproline
  VARIANT (188): Lys, Ser, Ala, Thr, Gly, or Val
  MOD_RES (189): Hydroxyproline
  VARIANT (190): Lys, Ser, Ala, Thr, Gly, or Val
  MOD_RES (191): Hydroxyproline
  VARIANT (192): Lys, Ser, Ala, Thr, Gly, or Val
  MOD_RES (193): Hydroxyproline
  VARIANT (194): Lys, Ser, Ala, Thr, Gly, or Val
  MOD_RES (195): Hydroxyproline
  VARIANT (196): Lys, Ser, Ala, Thr, Gly, or Val
  MOD_RES (197): Hydroxyproline
  VARIANT (198): Lys, Ser, Ala, Thr, Gly, or Val
  MOD_RES (199): Hydroxyproline
  VARIANT (200): Lys, Ser, Ala, Thr, Gly, or Val
  MOD_RES (201): Hydroxyproline
  VARIANT (202): Lys, Ser, Ala, Thr, Gly, or Val
  MOD_RES (203): Hydroxyproline
  VARIANT (204): Lys, Ser, Ala, Thr, Gly, or Val
  MOD_RES (205): Hydroxyproline
  VARIANT (206): Lys, Ser, Ala, Thr, Gly, or Val
  MOD_RES (207): Hydroxyproline
  VARIANT (208): Lys, Ser, Ala, Thr, Gly, or Val
  MOD_RES (209): Hydroxyproline
  VARIANT (210): Lys, Ser, Ala, Thr, Gly, or Val
  MOD_RES (211): Hydroxyproline
  VARIANT (212): Lys, Ser, Ala, Thr, Gly, or Val
  MOD_RES (213): Hydroxyproline
  VARIANT (214): Lys, Ser, Ala, Thr, Gly, or Val
  MOD_RES (215): Hydroxyproline
  VARIANT (216): Lys, Ser, Ala, Thr, Gly, or Val
  MOD_RES (217): Hydroxyproline
  VARIANT (218): Lys, Ser, Ala, Thr, Gly, or Val
  MOD_RES (219): Hydroxyproline
  VARIANT (220): Lys, Ser, Ala, Thr, Gly, or Val
  MOD_RES (221): Hydroxyproline
  VARIANT (222): Lys, Ser, Ala, Thr, Gly, or Val
  MOD_RES (223): Hydroxyproline
  VARIANT (224): Lys, Ser, Ala, Thr, Gly, or Val
  MOD_RES (225): Hydroxyproline
  VARIANT (226): Lys, Ser, Ala, Thr, Gly, or Val
  MOD_RES (227): Hydroxyproline
  VARIANT (228): Lys, Ser, Ala, Thr, Gly, or Val
  MOD_RES (229): Hydroxyproline
  VARIANT (230): Lys, Ser, Ala, Thr, Gly, or Val
  MOD_RES (231): Hydroxyproline
  VARIANT (232): Lys, Ser, Ala, Thr, Gly, or Val
  MOD_RES (233): Hydroxyproline
  VARIANT (234): Lys, Ser, Ala, Thr, Gly, or Val
  MOD_RES (235): Hydroxyproline
  VARIANT (236): Lys, Ser, Ala, Thr, Gly, or Val
  MOD_RES (237): Hydroxyproline
  VARIANT (238): Lys, Ser, Ala, Thr, Gly, or Val
  MOD_RES (239): Hydroxyproline
  VARIANT (240): Lys, Ser, Ala, Thr, Gly, or Val
  MOD_RES (241): Hydroxyproline
  VARIANT (242): Lys, Ser, Ala, Thr, Gly, or Val
  MOD_RES (243): Hydroxyproline
  VARIANT (244): Lys, Ser, Ala, Thr, Gly, or Val
  MOD_RES (245): Hydroxyproline
  VARIANT (246): Lys, Ser, Ala, Thr, Gly, or Val
  MOD_RES (247): Hydroxyproline
  VARIANT (248): Lys, Ser, Ala, Thr, Gly, or Val
  MOD_RES (249): Hydroxyproline
  VARIANT (250): Lys, Ser, Ala, Thr, Gly, or Val
  MOD_RES (251): Hydroxyproline
  VARIANT (252): Lys, Ser, Ala, Thr, Gly, or Val
  MOD_RES (253): Hydroxyproline
  VARIANT (254): Lys, Ser, Ala, Thr, Gly, or Val
  MOD_RES (255): Hydroxyproline
  VARIANT (256): Lys, Ser, Ala, Thr, Gly, or Val
  MOD_RES (257): Hydroxyproline
  VARIANT (258): Lys, Ser, Ala, Thr, Gly, or Val
  MOD_RES (259): Hydroxyproline
  VARIANT (260): Lys, Ser, Ala, Thr, Gly, or Val
  MOD_RES (261): Hydroxyproline
  VARIANT (262): Lys, Ser, Ala, Thr, Gly, or Val
  MOD_RES (263): Hydroxyproline
  VARIANT (264): Lys, Ser, Ala, Thr, Gly, or Val
  MOD_RES (265): Hydroxyproline
  VARIANT (266): Lys, Ser, Ala, Thr, Gly, or Val
  MOD_RES (267): Hydroxyproline
  VARIANT (268): Lys, Ser, Ala, Thr, Gly, or Val
  MOD_RES (269): Hydroxyproline
  VARIANT (270): Lys, Ser, Ala, Thr, Gly, or Val
  MOD_RES (271): Hydroxyproline
  VARIANT (272): Lys, Ser, Ala, Thr, Gly, or Val
  MOD_RES (273): Hydroxyproline
  VARIANT (274): Lys, Ser, Ala, Thr, Gly, or Val
  MOD_RES (275): Hydroxyproline
  VARIANT (276): Lys, Ser, Ala, Thr, Gly, or Val
  MOD_RES (277): Hydroxyproline
  VARIANT (278): Lys, Ser, Ala, Thr, Gly, or Val
  MOD_RES (279): Hydroxyproline
  VARIANT (280): Lys, Ser, Ala, Thr, Gly, or Val
  MOD_RES (281): Hydroxyproline
  VARIANT (282): Lys, Ser, Ala, Thr, Gly, or Val
  MOD_RES (283): Hydroxyproline
  VARIANT (284): Lys, Ser, Ala, Thr, Gly, or Val
  MOD_RES (285): Hydroxyproline
  VARIANT (286): Lys, Ser, Ala, Thr, Gly, or Val
  MOD_RES (287): Hydroxyproline
  VARIANT (288): Lys, Ser, Ala, Thr, Gly, or Val
  MOD_RES (289): Hydroxyproline
  VARIANT (290): Lys, Ser, Ala, Thr, Gly, or Val
  MOD_RES (291): Hydroxyproline
  VARIANT (292): Lys, Ser, Ala, Thr, Gly, or Val
  MOD_RES (293): Hydroxyproline
  VARIANT (294): Lys, Ser, Ala, Thr, Gly, or Val
  MOD_RES (295): Hydroxyproline
  VARIANT (296): Lys, Ser, Ala, Thr, Gly, or Val
  MOD_RES (297): Hydroxyproline
  VARIANT (298): Lys, Ser, Ala, Thr, Gly, or Val
  MOD_RES (299): Hydroxyproline
  VARIANT (300): Lys, Ser, Ala, Thr, Gly, or Val
  MOD_RES (301): Hydroxyproline
  VARIANT (302): Lys, Ser, Ala, Thr, Gly, or Val
  MOD_RES (303): Hydroxyproline
  VARIANT (304): Lys, Ser, Ala, Thr, Gly, or Val
  MOD_RES (305): Hydroxyproline
  VARIANT (306): Lys, Ser, Ala, Thr, Gly, or Val
  MOD_RES (307): Hydroxyproline
  VARIANT (308): Lys, Ser, Ala, Thr, Gly, or Val
  MOD_RES (309): Hydroxyproline
  VARIANT (310): Lys, Ser, Ala, Thr, Gly, or Val
  MOD_RES (311): Hydroxyproline
  VARIANT (312): Lys, Ser, Ala, Thr, Gly, or Val
  MOD_RES (313): Hydroxyproline
  VARIANT (314): Lys, Ser, Ala, Thr, Gly, or Val
  MOD_RES (315): Hydroxyproline
  VARIANT (316): Lys, Ser, Ala, Thr, Gly, or Val
  MOD_RES (317): Hydroxyproline
  VARIANT (318): Lys, Ser, Ala, Thr, Gly, or Val
  MOD_RES (319): Hydroxyproline
  VARIANT (320): Lys, Ser, Ala, Thr, Gly, or Val
  MOD_RES (321): Hydroxyproline
  VARIANT (322): Lys, Ser, Ala, Thr, Gly, or Val
  MOD_RES (323): Hydroxyproline
  VARIANT (324): Lys, Ser, Ala, Thr, Gly, or Val
  MOD_RES (325): Hydroxyproline
  VARIANT (326): Lys, Ser, Ala, Thr, Gly, or Val
  MOD_RES (327): Hydroxyproline
  VARIANT (328): Lys, Ser, Ala, Thr, Gly, or Val
  MOD_RES (329): Hydroxyproline
  VARIANT (330): Lys, Ser, Ala, Thr, Gly, or Val
  MOD_RES (331): Hydroxyproline
  VARIANT (332): Lys, Ser, Ala, Thr, Gly, or Val
  MOD_RES (333): Hydroxyproline
  VARIANT (334): Lys, Ser, Ala, Thr, Gly, or Val
  MOD_RES (335): Hydroxyproline
  VARIANT (336): Lys, Ser, Ala, Thr, Gly, or Val
  MOD_RES (337): Hydroxyproline
  VARIANT (338): Lys, Ser, Ala, Thr, Gly, or Val
  MOD_RES (339): Hydroxyproline
  VARIANT (340): Lys, Ser, Ala, Thr, Gly, or Val
  MOD_RES (341): Hydroxyproline
  VARIANT (342): Lys, Ser, Ala, Thr, Gly, or Val
  MOD_RES (343): Hydroxyproline
  VARIANT (344): Lys, Ser, Ala, Thr, Gly, or Val
  MOD_RES (345): Hydroxyproline
  VARIANT (346): Lys, Ser, Ala, Thr, Gly, or Val
  MOD_RES (347): Hydroxyproline
  VARIANT (348): Lys, Ser, Ala, Thr, Gly, or Val
  MOD_RES (349): Hydroxyproline
  VARIANT (350): Lys, Ser, Ala, Thr, Gly, or Val
  MOD_RES (351): Hydroxyproline
  VARIANT (352): Lys, Ser, Ala, Thr, Gly, or Val
  MOD_RES (353): Hydroxyproline
  VARIANT (354): Lys, Ser, Ala, Thr, Gly, or Val
  MOD_RES (355): Hydroxyproline
  VARIANT (356): Lys, Ser, Ala, Thr, Gly, or Val
  MOD_RES (357): Hydroxyproline
  VARIANT (358): Lys, Ser, Ala, Thr, Gly, or Val
  MOD_RES (359): Hydroxyproline
  VARIANT (360): Lys, Ser, Ala, Thr, Gly, or Val
  MOD_RES (361): Hydroxyproline
  VARIANT (362): Lys, Ser, Ala, Thr, Gly, or Val
  MOD_RES (363): Hydroxyproline
  VARIANT (364): Lys, Ser, Ala, Thr, Gly, or Val
  MOD_RES (365): Hydroxyproline
  VARIANT (366): Lys, Ser, Ala, Thr, Gly, or Val
  MOD_RES (367): Hydroxyproline
  VARIANT (368): Lys, Ser, Ala, Thr, Gly, or Val
  MOD_RES (369): Hydroxyproline
  VARIANT (370): Lys, Ser, Ala, Thr, Gly, or Val
  MOD_RES (371): Hydroxyproline
  VARIANT (372): Lys, Ser, Ala, Thr, Gly, or Val
  MOD_RES (373): Hydroxyproline
  VARIANT (374): Lys, Ser, Ala, Thr, Gly, or Val
  MOD_RES (375): Hydroxyproline
  VARIANT (376): Lys, Ser, Ala, Thr, Gly, or Val
  MOD_RES (377): Hydroxyproline
  VARIANT (378): Lys, Ser, Ala, Thr, Gly, or Val
  MOD_RES (379): Hydroxyproline
  VARIANT (380): Lys, Ser, Ala, Thr, Gly, or Val
  MOD_RES (381): Hydroxyproline
  VARIANT (382): Lys, Ser, Ala, Thr, Gly, or Val
  MOD_RES (383): Hydroxyproline
  VARIANT (384): Lys, Ser, Ala, Thr, Gly, or Val
  MOD_RES (385): Hydroxyproline
  VARIANT (386): Lys, Ser, Ala, Thr, Gly, or Val
  MOD_RES (387): Hydroxyproline
  VARIANT (388): Lys, Ser, Ala, Thr, Gly, or Val
  MOD_RES (389): Hydroxyproline
  VARIANT (390): Lys, Ser, Ala, Thr, Gly, or Val
  MOD_RES (391): Hydroxyproline
  VARIANT (392): Lys, Ser, Ala, Thr, Gly, or Val
  MOD_RES (393): Hydroxyproline
  VARIANT (394): Lys, Ser, Ala, Thr, Gly, or Val
  MOD_RES (395): Hydroxyproline
  VARIANT (396): Lys, Ser, Ala, Thr, Gly, or Val
  MOD_RES (397): Hydroxyproline
  VARIANT (398): Lys, Ser, Ala, Thr, Gly, or Val
  MOD_RES (399): Hydroxyproline
  VARIANT (400): Lys, Ser, Ala, Thr, Gly, or Val
  MOD_RES (401): Hydroxyproline
  VARIANT (402): Lys, Ser, Ala, Thr, Gly, or Val
  MOD_RES (403): Hydroxyproline
  VARIANT (404): Lys, Ser, Ala, Thr, Gly, or Val
  MOD_RES (405): Hydroxyproline
  VARIANT (406): Lys, Ser, Ala, Thr, Gly, or Val
  MOD_RES (407): Hydroxyproline
  VARIANT (408): Lys, Ser, Ala, Thr, Gly, or Val
  MOD_RES (409): Hydroxyproline
  VARIANT (410): Lys, Ser, Ala, Thr, Gly, or Val
  MOD_RES (411): Hydroxyproline
  VARIANT (412): Lys, Ser, Ala, Thr, Gly, or Val
  MOD_RES (413): Hydroxyproline
  VARIANT (414): Lys, Ser, Ala, Thr, Gly, or Val
  MOD_RES (415): Hydroxyproline
  VARIANT (416): Lys, Ser, Ala, Thr, Gly, or Val
  MOD_RES (417): Hydroxyproline
  VARIANT (418): Lys, Ser, Ala, Thr, Gly, or Val
  MOD_RES (419): Hydroxyproline
  VARIANT (420): Lys, Ser, Ala, Thr, Gly, or Val
  MOD_RES (421): Hydroxyproline
  VARIANT (422): Lys, Ser, Ala, Thr, Gly, or Val
  MOD_RES (423): Hydroxyproline
  VARIANT (424): Lys, Ser, Ala, Thr, Gly, or Val
  MOD_RES (425): Hydroxyproline
  VARIANT (426): Lys, Ser, Ala, Thr, Gly, or Val
  MOD_RES (427): Hydroxyproline
  VARIANT (428): Lys, Ser, Ala, Thr, Gly, or Val
  MOD_RES (429): Hydroxyproline
  VARIANT (430): Lys, Ser, Ala, Thr, Gly, or Val
  MOD_RES (431): Hydroxyproline
  VARIANT (432): Lys, Ser, Ala, Thr, Gly, or Val
  MOD_RES (433): Hydroxyproline
  VARIANT (434): Lys, Ser, Ala, Thr, Gly, or Val
  MOD_RES (435): Hydroxyproline
  VARIANT (436): Lys, Ser, Ala, Thr, Gly, or Val
  MOD_RES (437): Hydroxyproline
  VARIANT (438): Lys, Ser, Ala, Thr, Gly, or Val
  MOD_RES (439): Hydroxyproline
  VARIANT (440): Lys, Ser, Ala, Thr, Gly, or Val
  MOD_RES (441): Hydroxyproline
  VARIANT (442): Lys, Ser, Ala, Thr, Gly, or Val
  MOD_RES (443): Hydroxyproline
  VARIANT (444): Lys, Ser, Ala, Thr, Gly, or Val
  MOD_RES (445): Hydroxyproline
  VARIANT (446): Lys, Ser, Ala, Thr, Gly, or Val
  MOD_RES (447): Hydroxyproline
  VARIANT (448): Lys, Ser, Ala, Thr, Gly, or Val
  MOD_RES (449): Hydroxyproline
  VARIANT (450): Lys, Ser, Ala, Thr, Gly, or Val
  MOD_RES (451): Hydroxyproline
  VARIANT (452): Lys, Ser, Ala, Thr, Gly, or Val
  MOD_RES (453): Hydroxyproline
  VARIANT (454): Lys, Ser, Ala, Thr, Gly, or Val
  MOD_RES (455): Hydroxyproline
  VARIANT (456): Lys, Ser, Ala, Thr, Gly, or Val
  MOD_RES (457): Hydroxyproline
  VARIANT (458): Lys, Ser, Ala, Thr, Gly, or Val
  MOD_RES (459): Hydroxyproline
  VARIANT (460): Lys, Ser, Ala, Thr, Gly, or Val
  MOD_RES (461): Hydroxyproline
  VARIANT (462): Lys, Ser, Ala, Thr, Gly, or Val
  MOD_RES (463): Hydroxyproline
  VARIANT (464): Lys, Ser, Ala, Thr, Gly, or Val
  MOD_RES (465): Hydroxyproline
  VARIANT (466): Lys, Ser, Ala, Thr, Gly, or Val
  MOD_RES (467): Hydroxyproline
  VARIANT (468): Lys, Ser, Ala, Thr, Gly, or Val
  MOD_RES (469): Hydroxyproline
  VARIANT (470): Lys, Ser, Ala, Thr, Gly, or Val
  MOD_RES (471): Hydroxyproline
  VARIANT (472): Lys, Ser, Ala, Thr, Gly, or Val
  MOD_RES (473): Hydroxyproline
  VARIANT (474): Lys, Ser, Ala, Thr, Gly, or Val
  MOD_RES (475): Hydroxyproline
  VARIANT (476): Lys, Ser, Ala, Thr, Gly, or Val
  MOD_RES (477): Hydroxyproline
  VARIANT (478): Lys, Ser, Ala, Thr, Gly, or Val
  MOD_RES (479): Hydroxyproline
  VARIANT (480): Lys, Ser, Ala, Thr, Gly, or Val
  MOD_RES (481): Hydroxyproline
  VARIANT (482): Lys, Ser, Ala, Thr, Gly, or Val
  MOD_RES (483): Hydroxyproline
  VARIANT (484): Lys, Ser, Ala, Thr, Gly, or Val
  MOD_RES (485): Hydroxyproline
  VARIANT (486): Lys, Ser, Ala, Thr, Gly, or Val
  MOD_RES (487): Hydroxyproline
  VARIANT (488): Lys, Ser, Ala, Thr, Gly, or Val
  MOD_RES (489): Hydroxyproline
  VARIANT (490): Lys, Ser, Ala, Thr, Gly, or Val
  MOD_RES (491): Hydroxyproline
  VARIANT (492): Lys, Ser, Ala, Thr, Gly, or Val
  MOD_RES (493): Hydroxyproline
  VARIANT (494): Lys, Ser, Ala, Thr, Gly, or Val
  MOD_RES (495): Hydroxyproline
  VARIANT (496): Lys, Ser, Ala, Thr, Gly, or Val
  MOD_RES (497): Hydroxyproline
  VARIANT (498): Lys, Ser, Ala, Thr, Gly, or Val
  MOD_RES (499): Hydroxyproline
  VARIANT (500): Lys, Ser, Ala, Thr, Gly, or Val
  MOD_RES (501): Hydroxyproline
  VARIANT (502): Lys, Ser, Ala, Thr, Gly, or Val
  MOD_RES (503): Hydroxyproline
  VARIANT (504): Lys, Ser, Ala, Thr, Gly, or Val
  MOD_RES (505): Hydroxyproline
  VARIANT (506): Lys, Ser, Ala, Thr, Gly, or Val
  MOD_RES (507): Hydroxyproline
  VARIANT (508): Lys, Ser, Ala, Thr, Gly, or Val
  MOD_RES (509): Hydroxyproline
  VARIANT (510): Lys, Ser, Ala, Thr, Gly, or Val
  MOD_RES (511): Hydroxyproline
  VARIANT (512): Lys, Ser, Ala, Thr, Gly, or Val
  MOD_RES (513): Hydroxyproline
  VARIANT (514): Lys, Ser, Ala, Thr, Gly, or Val
  MOD_RES (515): Hydroxyproline
  VARIANT (516): Lys, Ser, Ala, Thr, Gly, or Val
  MOD_RES (517): Hydroxyproline
  VARIANT (518): Lys, Ser, Ala, Thr, Gly, or Val
  MOD_RES (519): Hydroxyproline
  VARIANT (520): Lys, Ser, Ala, Thr, Gly, or Val
  MOD_RES (521): Hydroxyproline
  VARIANT (522): Lys, Ser, Ala, Thr, Gly, or Val
  MOD_RES (523): Hydroxyproline
  VARIANT (524): Lys, Ser, Ala, Thr, Gly, or Val
  MOD_RES (525): Hydroxyproline
  VARIANT (526): Lys, Ser, Ala, Thr, Gly, or Val
  MOD_RES (527): Hydroxyproline
  VARIANT (528): Lys, Ser, Ala, Thr, Gly, or Val
  MOD_RES (529): Hydroxyproline
  VARIANT (530): Lys, Ser, Ala, Thr, Gly, or Val
  MOD_RES (531): Hydroxyproline
  VARIANT (532): Lys, Ser, Ala, Thr, Gly, or Val
  MOD_RES (533): Hydroxyproline
  VARIANT (534): Lys, Ser, Ala, Thr, Gly, or Val
  MOD_RES (535): Hydroxyproline
  VARIANT (536): Lys, Ser, Ala, Thr, Gly, or Val
  MOD_RES (537): Hydroxyproline
  VARIANT (538): Lys, Ser, Ala, Thr, Gly, or Val
  MOD_RES (539): Hydroxyproline
  VARIANT (540): Lys, Ser, Ala, Thr, Gly, or Val
  MOD_RES (541): Hydroxyproline
  VARIANT (542): Lys, Ser, Ala, Thr, Gly, or Val
  MOD_RES (543): Hydroxyproline
  VARIANT (544): Lys, Ser, Ala, Thr, Gly, or Val
  MOD_RES (545): Hydroxyproline
  VARIANT (546): Lys, Ser, Ala, Thr, Gly, or Val
  MOD_RES (547): Hydroxyproline
  VARIANT (548): Lys, Ser, Ala, Thr, Gly, or Val
  MOD_RES (549): Hydroxyproline
  VARIANT (550): Lys, Ser, Ala, Thr, Gly, or Val
  MOD_RES (551): Hydroxyproline
  VARIANT (552): Lys, Ser, Ala, Thr, Gly, or Val
  MOD_RES (553): Hydroxyproline
  VARIANT (554): Lys, Ser, Ala, Thr, Gly, or Val
  MOD_RES (555): Hydroxyproline
  VARIANT (556): Lys, Ser, Ala, Thr, Gly, or Val
  MOD_RES (557): Hydroxyproline
  VARIANT (558): Lys, Ser, Ala, Thr, Gly, or Val
  MOD_RES (559): Hydroxyproline
  VARIANT (560): Lys, Ser, Ala, Thr, Gly, or Val
  MOD_RES (561): Hydroxyproline
  VARIANT (562): Lys, Ser, Ala, Thr, Gly, or Val
  MOD_RES (563): Hydroxyproline
  VARIANT (564): Lys, Ser, Ala, Thr, Gly, or Val
  MOD_RES (565): Hydroxyproline
  VARIANT (566): Lys, Ser, Ala, Thr, Gly, or Val
  MOD_RES (567): Hydroxyproline
  VARIANT (568): Lys, Ser, Ala, Thr, Gly, or Val
  MOD_RES (569): Hydroxyproline
  VARIANT (570): Lys, Ser, Ala, Thr, Gly, or Val
  MOD_RES (571): Hydroxyproline
  VARIANT (572): Lys, Ser, Ala, Thr, Gly, or Val
  MOD_RES (573): Hydroxyproline
  VARIANT (574): Lys, Ser, Ala, Thr, Gly, or Val
  MOD_RES (575): Hydroxyproline
  VARIANT (576): Lys, Ser, Ala, Thr, Gly, or Val
  MOD_RES (577): Hydroxyproline
  VARIANT (578): Lys, Ser, Ala, Thr, Gly, or Val
  MOD_RES (579): Hydroxyproline
  VARIANT (580): Lys, Ser, Ala, Thr, Gly, or Val
  MOD_RES (581): Hydroxyproline
  VARIANT (582): Lys, Ser, Ala, Thr, Gly, or Val
  MOD_RES (583): Hydroxyproline
  VARIANT (584): Lys, Ser, Ala, Thr, Gly, or Val
  MOD_RES (585): Hydroxyproline
  VARIANT (586): Lys, Ser, Ala, Thr, Gly, or Val
  MOD_RES (587): Hydroxyproline
  VARIANT (588): Lys, Ser, Ala, Thr, Gly, or Val
  MOD_RES (589): Hydroxyproline
  VARIANT (590): Lys, Ser, Ala, Thr, Gly, or Val
  MOD_RES (591): Hydroxyproline
  VARIANT (592): Lys, Ser, Ala, Thr, Gly, or Val
  MOD_RES (593): Hydroxyproline
  VARIANT (594): Lys, Ser, Ala, Thr, Gly, or Val
  MOD_RES (595): Hydroxyproline
  VARIANT (596): Lys, Ser, Ala, Thr, Gly, or Val
  MOD_RES (597): Hydroxyproline
  VARIANT (598): Lys, Ser, Ala, Thr, Gly, or Val
  MOD_RES (599): Hydroxyproline
  VARIANT (600): Lys, Ser, Ala, Thr, Gly, or Val
  MOD_RES (601): Hydroxyproline
  VARIANT (602): Lys, Ser, Ala, Thr, Gly, or Val
  MOD_RES (603): Hydroxyproline
  VARIANT (604): Lys, Ser, Ala, Thr, Gly, or Val
  MOD_RES (605): Hydroxyproline
  VARIANT (606): Lys, Ser, Ala, Thr, Gly, or Val
  MOD_RES (607): Hydroxyproline
  VARIANT (608): Lys, Ser, Ala, Thr, Gly, or Val
  MOD_RES (609): Hydroxyproline
  VARIANT (610): Lys, Ser, Ala, Thr, Gly, or Val
  MOD_RES (611): Hydroxyproline
  VARIANT (612): Lys, Ser, Ala, Thr, Gly, or Val
  MOD_RES (613): Hydroxyproline
  VARIANT (614): Lys, Ser, Ala, Thr, Gly, or Val
  MOD_RES (615): Hydroxyproline
  VARIANT (616): Lys, Ser, Ala, Thr, Gly, or Val
  MOD_RES (617): Hydroxyproline
  VARIANT (618): Lys, Ser, Ala, Thr, Gly, or Val
  MOD_RES (619): Hydroxyproline
  VARIANT (620): Lys, Ser, Ala, Thr, Gly, or Val
  MOD_RES (621): Hydroxyproline
  VARIANT (622): Lys, Ser, Ala, Thr, Gly, or Val
  MOD_RES (623): Hydroxyproline
  VARIANT (624): Lys, Ser, Ala, Thr, Gly, or Val
  MOD_RES (625): Hydroxyproline
  VARIANT (626): Lys, Ser, Ala, Thr, Gly, or Val
  MOD_RES (627): Hydroxyproline
  VARIANT (628): Lys, Ser, Ala, Thr, Gly, or Val
  MOD_RES (629): Hydroxyproline
  VARIANT (630): Lys, Ser, Ala, Thr, Gly, or Val
  MOD_RES (631): Hydroxyproline
  VARIANT (632): Lys, Ser, Ala, Thr, Gly, or Val
  MOD_RES (633): Hydroxyproline
  VARIANT (634): Lys, Ser, Ala, Thr, Gly, or Val
  MOD_RES (635): Hydroxyproline
  VARIANT (636): Lys, Ser, Ala, Thr, Gly, or Val
  MOD_RES (637): Hydroxyproline
  VARIANT (638): Lys, Ser, Ala, Thr, Gly, or Val
  MOD_RES (639): Hydroxyproline
  VARIANT (640): Lys, Ser, Ala, Thr, Gly, or Val
  MOD_RES (641): Hydroxyproline
  VARIANT (642): Lys, Ser, Ala, Thr, Gly, or Val
  MOD_RES (643): Hydroxyproline
  VARIANT (644): Lys, Ser, Ala, Thr, Gly, or Val
  MOD_RES (645): Hydroxyproline
  VARIANT (646): Lys, Ser, Ala, Thr, Gly, or Val
  MOD_RES (647): Hydroxyproline
  VARIANT (648): Lys, Ser, Ala, Thr, Gly, or Val
  MOD_RES (649): Hydroxyproline
  VARIANT (650): Lys, Ser, Ala, Thr, Gly, or Val
  MOD_RES (651): Hydroxyproline
  VARIANT (652): Lys, Ser, Ala, Thr, Gly, or Val
  MOD_RES (653): Hydroxyproline
  VARIANT (654): Lys, Ser, Ala, Thr, Gly, or Val
  MOD_RES (655): Hydroxyproline
  VARIANT (656): Lys, Ser, Ala, Thr, Gly, or Val
  MOD_RES (657): Hydroxyproline
  VARIANT (658): Lys, Ser, Ala, Thr, Gly, or Val
  MOD_RES (659): Hydroxyproline
  VARIANT (660): Lys, Ser, Ala, Thr, Gly, or Val
  MOD_RES (661): Hydroxyproline
  VARIANT (662): Lys, Ser, Ala, Thr, Gly, or Val
  MOD_RES (663): Hydroxyproline
  VARIANT (664): Lys, Ser, Ala, Thr, Gly, or Val
  MOD_RES (665): Hydroxyproline
  VARIANT (666): Lys, Ser, Ala, Thr, Gly, or Val
  MOD_RES (667): Hydroxyproline
  VARIANT (668): Lys, Ser, Ala, Thr, Gly, or Val
  MOD_RES (669): Hydroxyproline
  VARIANT (670): Lys, Ser, Ala, Thr, Gly, or Val
  MOD_RES (671): Hydroxyproline
  VARIANT (672): Lys, Ser, Ala, Thr, Gly, or Val
  MOD_RES (673): Hydroxyproline
  VARIANT (674): Lys, Ser, Ala, Thr, Gly, or Val
  MOD_RES (675): Hydroxyproline
  VARIANT (676): Lys, Ser, Ala, Thr, Gly, or Val
  MOD_RES (677): Hydroxyproline
  VARIANT (678): Lys, Ser, Ala, Thr, Gly, or Val
  MOD_RES (679): Hydroxyproline
  VARIANT (680): Lys, Ser, Ala, Thr, Gly, or Val
  MOD_RES (681): Hydroxyproline
  VARIANT (682): Lys, Ser, Ala, Thr, Gly, or Val
  MOD_RES (683): Hydroxyproline
  VARIANT (684): Lys, Ser, Ala, Thr, Gly, or Val
  MOD_RES (685): Hydroxyproline
  VARIANT (686): Lys, Ser, Ala, Thr, Gly, or Val
  MOD_RES (687): Hydroxyproline
  VARIANT (688): Lys, Ser, Ala, Thr, Gly, or Val
  MOD_RES (689): Hydroxyproline
  VARIANT (690): Lys, Ser, Ala, Thr, Gly, or Val
  MOD_RES (691): Hydroxyproline
  VARIANT (692): Lys, Ser, Ala, Thr, Gly, or Val
  MOD_RES (693): Hydroxyproline
  VARIANT (694): Lys, Ser, Ala, Thr, Gly, or Val
  MOD_RES (695): Hydroxyproline
  VARIANT (696): Lys, Ser, Ala, Thr, Gly, or Val
  MOD_RES (697): Hydroxyproline
  VARIANT (698): Lys, Ser, Ala, Thr, Gly, or Val
  MOD_RES (699): Hydroxyproline
  VARIANT (700): Lys, Ser, Ala, Thr, Gly, or Val
  MOD_RES (701): Hydroxyproline
  VARIANT (702): Lys, Ser, Ala, Thr, Gly, or Val
  MOD_RES (703): Hydroxyproline
  VARIANT (704): Lys, Ser, Ala, Thr, Gly, or Val
  MOD_RES (705): Hydroxyproline
  VARIANT (706): Lys, Ser, Ala, Thr, Gly, or Val
  MOD_RES (707): Hydroxyproline
  VARIANT (708): Lys, Ser, Ala, Thr, Gly, or Val
  MOD_RES (709): Hydroxyproline
  VARIANT (710): Lys, Ser, Ala, Thr, Gly, or Val
  MOD_RES (711): Hydroxyproline
  VARIANT (712): Lys, Ser, Ala, Thr, Gly, or Val
  MOD_RES (713): Hydroxyproline
  VARIANT (714): Lys, Ser, Ala, Thr, Gly, or Val
  MOD_RES (715): Hydroxyproline
  VARIANT (716): Lys, Ser, Ala, Thr, Gly, or Val
  MOD_RES (717): Hydroxyproline
  VARIANT (718): Lys, Ser, Ala, Thr, Gly, or Val
  MOD_RES (719): Hydroxyproline
  VARIANT (720): Lys, Ser, Ala, Thr, Gly, or Val
  MOD_RES (721): Hydroxyproline
  VARIANT (722): Lys, Ser, Ala, Thr, Gly, or Val
  MOD_RES (723): Hydroxyproline
  VARIANT (724): Lys, Ser, Ala, Thr, Gly, or Val
  MOD_RES (725): Hydroxyproline
  VARIANT (726): Lys, Ser, Ala, Thr, Gly, or Val
  MOD_RES (727): Hydroxyproline
  VARIANT (728): Lys, Ser, Ala, Thr, Gly, or Val
  MOD_RES (729): Hydroxyproline
  VARIANT (730): Lys, Ser, Ala, Thr, Gly, or Val
  MOD_RES (731): Hydroxyproline
  VARIANT (732): Lys, Ser, Ala, Thr, Gly, or Val
  MOD_RES (733): Hydroxyproline
  VARIANT (734): Lys, Ser, Ala, Thr, Gly, or Val
  MOD_RES (735): Hydroxyproline
  VARIANT (736): Lys, Ser, Ala, Thr, Gly, or Val
  MOD_RES (737): Hydroxyproline
  VARIANT (738): Lys, Ser, Ala, Thr, Gly, or Val
  MOD_RES (739): Hydroxyproline
  VARIANT (740): Lys, Ser, Ala, Thr, Gly, or Val
  MOD_RES (741): Hydroxyproline
  VARIANT (742): Lys, Ser, Ala, Thr, Gly, or Val
  MOD_RES (743): Hydroxyproline
  VARIANT (744): Lys, Ser, Ala, Thr, Gly, or Val
  MOD_RES (745): Hydroxyproline
  VARIANT (746): Lys, Ser, Ala, Thr, Gly, or Val
  MOD_RES (747): Hydroxyproline
  VARIANT (748): Lys, Ser, Ala, Thr, Gly, or Val
  MOD_RES (749): Hydroxyproline
  VARIANT (750): Lys, Ser, Ala, Thr, Gly, or Val
  MOD_RES (751): Hydroxyproline
  VARIANT (752): Lys, Ser, Ala, Thr, Gly, or Val
  MOD_RES (753): Hydroxyproline
  VARIANT (754): Lys, Ser, Ala, Thr, Gly, or Val
  MOD_RES (755): Hydroxyproline
  VARIANT (756): Lys, Ser, Ala, Thr, Gly, or Val
  MOD_RES (757): Hydroxyproline
  VARIANT (758): Lys, Ser, Ala, Thr, Gly, or Val
  MOD_RES (759): Hydroxyproline
  VARIANT (760): Lys, Ser, Ala, Thr, Gly, or Val
  MOD_RES (761): Hydroxyproline
  VARIANT (762): Lys, Ser, Ala, Thr, Gly, or Val
  MOD_RES (763): Hydroxyproline
  VARIANT (764): Lys, Ser, Ala, Thr, Gly, or Val
  MOD_RES (765): Hydroxyproline
  VARIANT (766): Lys, Ser, Ala, Thr, Gly, or Val
  MOD_RES (767): Hydroxyproline
  VARIANT (768): Lys, Ser, Ala, Thr, Gly, or Val
  MOD_RES (769): Hydroxyproline
  VARIANT (770): Lys, Ser, Ala, Thr, Gly, or Val
  MOD_RES (771): Hydroxyproline
  VARIANT (772): Lys, Ser, Ala, Thr, Gly, or Val
  MOD_RES (773): Hydroxyproline
  VARIANT (774): Lys, Ser, Ala, Thr, Gly, or Val
  MOD_RES (775): Hydroxyproline
  VARIANT (776): Lys, Ser, Ala, Thr, Gly, or Val
  MOD_RES (777): Hydroxyproline
  VARIANT (778): Lys, Ser, Ala, Thr, Gly, or Val
  MOD_RES (779): Hydroxyproline
  VARIANT (780): Lys, Ser, Ala, Thr, Gly, or Val
  MOD_RES (781): Hydroxyproline
  VARIANT (782): Lys, Ser, Ala, Thr, Gly, or Val
  MOD_RES (783): Hydroxyproline
  VARIANT (784): Lys, Ser, Ala, Thr, Gly, or Val
  MOD_RES (785): Hydroxyproline
  VARIANT (786): Lys, Ser, Ala, Thr, Gly, or Val
  MOD_RES (787): Hydroxyproline
  VARIANT (788): Lys, Ser, Ala, Thr, Gly, or Val
  MOD_RES (789): Hydroxyproline
  VARIANT (790): Lys, Ser, Ala, Thr, Gly, or Val
  MOD_RES (791): Hydroxyproline
  VARIANT (792): Lys, Ser, Ala, Thr, Gly, or Val
  MOD_RES (793): Hydroxyproline
  VARIANT (794): Lys, Ser, Ala, Thr, Gly, or Val
  MOD_RES (795): Hydroxyproline
  VARIANT (796): Lys, Ser, Ala, Thr, Gly, or Val
  MOD_RES (797): Hydroxyproline
  VARIANT (798): Lys, Ser, Ala, Thr, Gly, or Val
  MOD_RES (799): Hydroxyproline
  VARIANT (800): Lys, Ser, Ala, Thr, Gly, or Val
  MOD_RES (801): Hydroxyproline
  VARIANT (802): Lys, Ser, Ala, Thr, Gly, or Val
  MOD_RES (803): Hydroxyproline
  VARIANT (804): Lys, Ser, Ala, Thr, Gly, or Val
  MOD_RES (805): Hydroxyproline
  VARIANT (806): Lys, Ser, Ala, Thr, Gly, or Val
  MOD_RES (807): Hydroxyproline
  VARIANT (808): Lys, Ser, Ala, Thr, Gly, or Val
  MOD_RES (809): Hydroxyproline
  VARIANT (810): Lys, Ser, Ala, Thr, Gly, or Val
  MOD_RES (811): Hydroxyproline
  VARIANT (812): Lys, Ser, Ala, Thr, Gly, or Val
  MOD_RES (813): Hydroxyproline
  VARIANT (814): Lys, Ser, Ala, Thr, Gly, or Val
  MOD_RES (815): Hydroxyproline
  VARIANT (816): Lys, Ser, Ala, Thr, Gly, or Val
  MOD_RES (817): Hydroxyproline
  VARIANT (818): Lys, Ser, Ala, Thr, Gly, or Val
  MOD_RES (819): Hydroxyproline
  VARIANT (820): Lys, Ser, Ala, Thr, Gly, or Val
  MOD_RES (821): Hydroxyproline
  VARIANT (822): Lys, Ser, Ala, Thr, Gly, or Val
  MOD_RES (823): Hydroxyproline
  VARIANT (824): Lys, Ser, Ala, Thr, Gly, or Val
  MOD_RES (825): Hydroxyproline
  VARIANT (826): Lys, Ser, Ala, Thr, Gly, or Val
  MOD_RES (827): Hydroxyproline
  VARIANT (828): Lys, Ser, Ala, Thr, Gly, or Val
  MOD_RES (829): Hydroxyproline
  VARIANT (830): Lys, Ser, Ala, Thr, Gly, or Val
  MOD_RES (831): Hydroxyproline
  VARIANT (832): Lys, Ser, Ala, Thr, Gly, or Val
  MOD_RES (833): Hydroxyproline
  VARIANT (834): Lys, Ser, Ala, Thr, Gly, or Val
  MOD_RES (835): Hydroxyproline
  VARIANT (836): Lys, Ser, Ala, Thr, Gly, or Val
  MOD_RES (837): Hydroxyproline
  VARIANT (838): Lys, Ser, Ala, Thr, Gly, or Val
  MOD_RES (839): Hydroxyproline
  VARIANT (840): Lys, Ser, Ala, Thr, Gly, or Val
  MOD_RES (841): Hydroxyproline
  VARIANT (842): Lys, Ser, Ala, Thr, Gly, or Val
  MOD_RES (843): Hydroxyproline
  VARIANT (844): Lys, Ser, Ala, Thr, Gly, or Val
  MOD_RES (845): Hydroxyproline
  VARIANT (846): Lys, Ser, Ala, Thr, Gly, or Val
  MOD_RES (847): Hydroxyproline
  VARIANT (848): Lys, Ser, Ala, Thr, Gly, or Val
  MOD_RES (849): Hydroxyproline
  VARIANT (850): Lys, Ser, Ala, Thr, Gly, or Val
  MOD_RES (851): Hydroxyproline
  VARIANT (852): Lys, Ser, Ala, Thr, Gly, or Val
  MOD_RES (853): Hydroxyproline
  VARIANT (854): Lys, Ser, Ala, Thr, Gly, or Val
  MOD_RES (855): Hydroxyproline
  VARIANT (856): Lys, Ser, Ala, Thr, Gly, or Val
  MOD_RES (857): Hydroxyproline
  VARIANT (858): Lys, Ser, Ala, Thr, Gly, or Val
  MOD_RES (859): Hydroxyproline
  VARIANT (860): Lys, Ser, Ala, Thr, Gly, or Val
  MOD_RES (861): Hydroxyproline
  VARIANT (862): Lys, Ser, Ala, Thr, Gly, or Val
  MOD_RES (863): Hydroxyproline
  VARIANT (864): Lys, Ser, Ala, Thr, Gly, or Val
  MOD_RES (865): Hydroxyproline
  VARIANT (866): Lys, Ser, Ala, Thr, Gly, or Val
  MOD_RES (867): Hydroxyproline
  VARIANT (868): Lys, Ser, Ala, Thr, Gly, or Val
  MOD_RES (869): Hydroxyproline
  VARIANT (870): Lys, Ser, Ala, Thr, Gly, or Val
  MOD_RES (871): Hydroxyproline
  VARIANT (872): Lys, Ser, Ala, Thr, Gly, or Val
  MOD_RES (873): Hydroxyproline
  VARIANT (874): Lys, Ser, Ala, Thr, Gly, or Val
  MOD_RES (875): Hydroxyproline
  VARIANT (876): Lys, Ser, Ala, Thr, Gly, or Val
  MOD_RES (877): Hydroxyproline
  VARIANT (878): Lys, Ser, Ala, Thr, Gly, or Val
  MOD_RES (879): Hydroxyproline
  VARIANT (880): Lys, Ser, Ala, Thr, Gly, or Val
  MOD_RES (881): Hydroxyproline
  VARIANT (882): Lys, Ser, Ala, Thr, Gly, or Val
  MOD_RES (883): Hydroxyproline
  VARIANT (884): Lys, Ser, Ala, Thr, Gly, or Val
  MOD_RES (885): Hydroxyproline
  MOD_RES (886): Lys, Ser, Ala, Thr, Gly, or Val
  MOD_RES (887): Hydroxyproline
  VARIANT (888): Lys, Ser, Ala, Thr, Gly, or Val
  MOD_RES (889): Hydroxyproline
  VARIANT (890): Lys, Ser, Ala, Thr, Gly, or Val
  MOD_RES (891): Hydroxyproline
  VARIANT (892): Lys, Ser, Ala, Thr, Gly, or Val
  MOD_RES (893): Hydroxyproline
  VARIANT (894): Lys, Ser, Ala, Thr, Gly, or Val
  MOD_RES (895): Hydroxyproline
  VARIANT (896): Lys, Ser, Ala, Thr, Gly, or Val
  MOD_RES (897): Hydroxyproline
  VARIANT (898): Lys, Ser, Ala, Thr, Gly, or Val
  MOD_RES (899): Hydroxyproline
  VARIANT (900): Lys, Ser, Ala, Thr, Gly, or Val
  MOD_RES (901): Hydroxyproline
  VARIANT (902): Lys, Ser, Ala, Thr, Gly, or Val
  MOD_RES (903): Hydroxyproline
  VARIANT (904): Lys, Ser, Ala, Thr, Gly, or Val
  MOD_RES (905): Hydroxyproline
  VARIANT (906): Lys, Ser, Ala, Thr, Gly, or Val
  MOD_RES (907): Hydroxyproline
  VARIANT (908): Lys, Ser, Ala, Thr, Gly, or Val
  MOD_RES (909): Hydroxyproline
  VARIANT (910): Lys, Ser, Ala, Thr, Gly, or Val
  MOD_RES (911): Hydroxyproline
  VARIANT (912): Lys, Ser, Ala, Thr, Gly, or Val
  MOD_RES (913): Hydroxyproline
  VARIANT (914): Lys, Ser, Ala, Thr, Gly, or Val
  MOD_RES (915): Hydroxyproline
  VARIANT (916): Lys, Ser, Ala, Thr, Gly, or Val
  MOD_RES (917): Hydroxyproline
  VARIANT (918): Lys, Ser, Ala, Thr, Gly, or Val
  MOD_RES (919): Hydroxyproline
  VARIANT (920): Lys, Ser, Ala, Thr, Gly, or Val
  MOD_RES (921): Hydroxyproline
  VARIANT (922): Lys, Ser, Ala, Thr, Gly, or Val
  MOD_RES (923): Hydroxyproline
  VARIANT (924): Lys, Ser, Ala, Thr, Gly, or Val
  MOD_RES (925): Hydroxyproline
  VARIANT (926): Lys, Ser, Ala, Thr, Gly, or Val
  MOD_RES (927): Hydroxyproline
  VARIANT (928): Lys, Ser, Ala, Thr, Gly, or Val
  MOD_RES (929): Hydroxyproline
  VARIANT (930): Lys, Ser, Ala, Thr, Gly, or Val
  MOD_RES (931): Hydroxyproline
  VARIANT (932): Lys, Ser, Ala, Thr, Gly, or Val
  MOD_RES (933): Hydroxyproline
  VARIANT (934): Lys, Ser, Ala, Thr, Gly, or Val
  MOD_RES (935): Hydroxyproline
  VARIANT (936): Lys, Ser, Ala, Thr, Gly, or Val
  MOD_RES (937): Hydroxyproline
  VARIANT (938): Lys, Ser, Ala, Thr, Gly, or Val
  MOD_RES (939): Hydroxyproline
  VARIANT (940): Lys, Ser, Ala, Thr, Gly, or Val
  MOD_RES (941): Hydroxyproline
  VARIANT (942): Lys, Ser, Ala, Thr, Gly, or Val
  MOD_RES (943): Hydroxyproline
  VARIANT (944): Lys, Ser, Ala, Thr, Gly, or Val
  MOD_RES (945): Hydroxyproline
  VARIANT (946): Lys, Ser, Ala, Thr, Gly, or Val
  MOD_RES (947): Hydroxyproline
  VARIANT (948): Lys, Ser, Ala, Thr, Gly, or Val
  MOD_RES (949): Hydroxyproline
  VARIANT (950): Lys, Ser, Ala, Thr, Gly, or Val
  MOD_RES (951): Hydroxyproline
  VARIANT (952): Lys, Ser, Ala, Thr, Gly, or Val
  MOD_RES (953): Hydroxyproline
  VARIANT (954): Lys, Ser, Ala, Thr, Gly, or Val
  MOD_RES (955): Hydroxyproline
  VARIANT (956): Lys, Ser, Ala, Thr, Gly, or Val
  MOD_RES (957): Hydroxyproline
  VARIANT (958): Lys, Ser, Ala, Thr, Gly, or Val
  MOD_RES (959): Hydroxyproline
  vARIANT (960): Lys, Ser, Ala, Thr, Gly, or Val
  MOD_RES (961): Hydroxyproline
  vARIANT (962): Lys, Ser, Ala, Thr, Gly, or Val
  MOD_RES (963): Hydroxyproline
  VARIANT (964): Lys, Ser, Ala, Thr, Gly, or Val
  MOD_RES (965): Hydroxyproline
  VARIANT (966): Lys, Ser, Ala, Thr, Gly, or Val
  MOD_RES (967): Hydroxyproline
  VARIANT (968): Lys, Ser, Ala, Thr, Gly, or Val
  MOD_RES (969): Hydroxyproline
  VARIANT (970): Lys, Ser, Ala, Thr, Gly, or Val
  MOD_RES (971): Hydroxyproline
  VARIANT (972): Lys, Ser, Ala, Thr, Gly, or Val
  MOD_RES (973): Hydroxyproline
  VARIANT (974): Lys, Ser, Ala, Thr, Gly, or Val
  MOD_RES (975): Hydroxyproline
  VARIANT (976): Lys, Ser, Ala, Thr, Gly, or Val
  MOD_RES (977): Hydroxyproline
  VARIANT (978): Lys, Ser, Ala, Thr, Gly, or Val
  MOD_RES (979): Hydroxyproline
  VARIANT (980): Lys, Ser, Ala, Thr, Gly, or Val
  MOD_RES (981): Hydroxyproline
  VARIANT (982): Lys, Ser, Ala, Thr, Gly, or Val
  MOD_RES (983): Hydroxyproline
  VARIANT (984): Lys, Ser, Ala, Thr, Gly, or Val
  MOD_RES (985): Hydroxyproline
  VARIANT (986): Lys, Ser, Ala, Thr, Gly, or Val
  MOD_RES (987): Hydroxyproline
  VARIANT (988): Lys, Ser, Ala, Thr, Gly, or Val
  MOD_RES (989): Hydroxyproline
  VARIANT (990): Lys, Ser, Ala, Thr, Gly, or Val
  MOD_RES (991): Hydroxyproline
  VARIANT (992): Lys, Ser, Ala, Thr, Gly, or Val
  MOD_RES (993): Hydroxyproline
  VARIANT (994): Lys, Ser, Ala, Thr, Gly, or Val
  MOD_RES (995): Hydroxyproline
  VARIANT (996): Lys, Ser, Ala, Thr, Gly, or Val
  MOD_RES (997): Hydroxyproline
  VARIANT (998): Lys, Ser, Ala, Thr, Gly, or Val
  MOD_RES (999): Hydroxyproline
  VARIANT (1000): Lys, Ser, Ala, Thr, Gly, or Val
  MOD_RES (1001): Hydroxyproline
  VARIANT (1002): Lys, Ser, Ala, Thr, Gly, or Val
  MOD_RES (1003): Hydroxyproline
  VARIANT (1004): Lys, Ser, Ala, Thr, Gly, or Val
  MOD_RES (1005): Hydroxyproline
  VARIANT (1006): Lys, Ser, Ala, Thr, Gly, or Val
  MOD_RES (1007): Hydroxyproline
  VARIANT (1008): Lys, Ser, Ala, Thr, Gly, or Val
  MOD_RES (1009): Hydroxyproline
  VARIANT (1010): Lys, Ser, Ala, Thr, Gly, or Val
  MOD_RES (1011): Hydroxyproline
  VARIANT (1012): Lys, Ser, Ala, Thr, Gly, or Val
  MOD_RES (1013): Hydroxyproline
  VARIANT (1014): Lys, Ser, Ala, Thr, Gly, or Val
  MOD_RES (1015): Hydroxyproline
  VARIANT (1016): Lys, Ser, Ala, Thr, Gly, or Val
  MOD_RES (1017): Hydroxyproline
  VARIANT (1018): Lys, Ser, Ala, Thr, Gly, or Val
  MOD_RES (1019): Hydroxyproline
  VARIANT (1020): Lys, Ser, Ala, Thr, Gly, or Val
  MOD_RES (1021): Hydroxyproline
  VARIANT (1022): Lys, Ser, Ala, Thr, Gly, or Val
  MOD_RES (1023): Hydroxyproline
  VARIANT (1024): Lys, Ser, Ala, Thr, Gly, or Val
  MOD_RES (1025): Hydroxyproline
  VARIANT (1026): Lys, Ser, Ala, Thr, Gly, or Val
  MOD_RES (1027): Hydroxyproline
  VARIANT (1028): Lys, Ser, Ala, Thr, Gly, or Val
  MOD_RES (1029): Hydroxyproline
  VARIANT (1030): Lys, Ser, Ala, Thr, Gly, or Val
  MOD_RES (1031): Hydroxyproline
  VARIANT (1032): Lys, Ser, Ala, Thr, Gly, or Val
  MOD_RES (1033): Hydroxyproline
  VARIANT (1034): Lys, Ser, Ala, Thr, Gly, or Val
  MOD_RES (1035): Hydroxyproline
  VARIANT (1036): Lys, Ser, Ala, Thr, Gly, or Val
  MOD_RES (1037): Hydroxyproline
  VARIANT (1038): Lys, Ser, Ala, Thr, Gly, or Val
  MOD_RES (1039): Hydroxyproline
  VARIANT (1040): Lys, Ser, Ala, Thr, Gly, or Val
  MOD_RES (1041): Hydroxyproline
  VARIANT (1042): Lys, Ser, Ala, Thr, Gly, or Val
  MOD_RES (1043): Hydroxyproline
  VARIANT (1044): Lys, Ser, Ala, Thr, Gly, or Val
  MOD_RES (1045): Hydroxyproline
  VARIANT (1046): Lys, Ser, Ala, Thr, Gly, or Val
  MOD_RES (1047): Hydroxyproline
  VARIANT (1048): Lys, Ser, Ala, Thr, Gly, or Val
  MOD_RES (1049): Hydroxyproline
  VARIANT (1050): Lys, Ser, Ala, Thr, Gly, or Val
  MOD_RES (1051): Hydroxyproline
  VARIANT (1052): Lys, Ser, Ala, Thr, Gly, or Val
  MOD_RES (1053): Hydroxyproline
  VARIANT (1054): Lys, Ser, Ala, Thr, Gly, or Val
  MOD_RES (1055): Hydroxyproline
  VARIANT (1056): Lys, Ser, Ala, Thr, Gly, or Val
  MOD_RES (1057): Hydroxyproline
  VARIANT (1058): Lys, Ser, Ala, Thr, Gly, or Val
  MOD_RES (1059): Hydroxyproline
  VARIANT (1060): Lys, Ser, Ala, Thr, Gly, or Val
  MOD_RES (1061): Hydroxyproline
  VARIANT (1062): Lys, Ser, Ala, Thr, Gly, or Val
  MOD_RES (1063): Hydroxyproline
  VARIANT (1064): Lys, Ser, Ala, Thr, Gly, or Val
  MOD_RES (1065): Hydroxyproline
  VARIANT (1066): Lys, Ser, Ala, Thr, Gly, or Val
  MOD_RES (1067): Hydroxyproline
  VARIANT (1068): Lys, Ser, Ala, Thr, Gly, or Val
  MOD_RES (1069): Hydroxyproline
  VARIANT (1070): Lys, Ser, Ala, Thr, Gly, or Val
  MOD_RES (1071): Hydroxyproline
  VARIANT (1072): Lys, Ser, Ala, Thr, Gly, or Val
  MOD_RES (1073): Hydroxyproline
  VARIANT (1074): Lys, Ser, Ala, Thr, Gly, or Val
  MOD_RES (1075): Hydroxyproline
  VARIANT (1076): Lys, Ser, Ala, Thr, Gly, or Val
  VARIANT (1077): Hydroxyproline
  VARIANT (1078): Lys, Ser, Ala, Thr, Gly, or Val
  MOD_RES (1079): Hydroxyproline
  VARIANT (1080): Lys, Ser, Ala, Thr, Gly, or Val
  MOD_RES (1081): Hydroxyproline
  VARIANT (1082): Lys, Ser, Ala, Thr, Gly, or Val
  MOD_RES (1083): Hydroxyproline
  VARIANT (1084): Lys, Ser, Ala, Thr, Gly, or Val
  MOD_RES (1085): Hydroxyproline
  VARIANT (1086): Lys, Ser, Ala, Thr, Gly, or Val
  MOD_RES (1087): Hydroxyproline
  VARIANT (1088): Lys, Ser, Ala, Thr, Gly, or Val
  MOD_RES (1089): Hydroxyproline
  VARIANT (1090): Lys, Ser, Ala, Thr, Gly, or Val
  MOD_RES (1091): Hydroxyproline
  VARIANT (1092): Lys, Ser, Ala, Thr, Gly, or Val
  MOD_RES (1093): Hydroxyproline
  VARIANT (1094): Lys, Ser, Ala, Thr, Gly, or Val
  MOD_RES (1095): Hydroxyproline
  MOD_RES (1096): Lys, Ser, Ala, Thr, Gly, or Val
  MOD_RES (1097): Hydroxyproline
  VARIANT (1098): Lys, Ser, Ala, Thr, Gly, or Val
  MOD_RES (1099): Hydroxyproline
  VARIANT (1100): Lys, Ser, Ala, Thr, Gly, or Val
  MOD_RES (1101): Hydroxyproline
  VARIANT (1102): Lys, Ser, Ala, Thr, Gly, or Val
  MOD_RES (1103): Hydroxyproline
  VARIANT (1104): Lys, Ser, Ala, Thr, Gly, or Val
  MOD_RES (1105): Hydroxyproline
  VARIANT (1106): Lys, Ser, Ala, Thr, Gly, or Val
  MOD_RES (1107): Hydroxyproline
  VARIANT (1108): Lys, Ser, Ala, Thr, Gly, or Val
  MOD_RES (1109): Hydroxyproline
  VARIANT (1110): Lys, Ser, Ala, Thr, Gly, or Val
  MOD_RES (1111): Hydroxyproline
  VARIANT (1112): Lys, Ser, Ala, Thr, Gly, or Val
  MOD_RES (1113): Hydroxyproline
  VARIANT (1114): Lys, Ser, Ala, Thr, Gly, or Val
  MOD_RES (1115): Hydroxyproline
  VARIANT (1116): Lys, Ser, Ala, Thr, Gly, or Val
  MOD_RES (1117): Hydroxyproline
  VARIANT (1118): Lys, Ser, Ala, Thr, Gly, or Val
  MOD_RES (1119): Hydroxyproline
  VARIANT (1120): Lys, Ser, Ala, Thr, Gly, or Val
  MOD_RES (1121): Hydroxyproline
  VARIANT (1122): Lys, Ser, Ala, Thr, Gly, or Val
  MOD_RES (1123): Hydroxyproline
  VARIANT (1124): Lys, Ser, Ala, Thr, Gly, or Val
  MOD_RES (1125): Hydroxyproline
  VARIANT (1126): Lys, Ser, Ala, Thr, Gly, or Val
  MOD_RES (1127): Hydroxyproline
  VARIANT (1128): Lys, Ser, Ala, Thr, Gly, or Val
  MOD_RES (1129): Hydroxyproline
  VARIANT (1130): Lys, Ser, Ala, Thr, Gly, or Val
  MOD_RES (1131): Hydroxyproline
  VARIANT (1132): Lys, Ser, Ala, Thr, Gly, or Val
  MOD_RES (1133): Hydroxyproline
  VARIANT (1134): Lys, Ser, Ala, Thr, Gly, or Val
  MOD_RES (1135): Hydroxyproline
  VARIANT (1136): Lys, Ser, Ala, Thr, Gly, or Val
  MOD_RES (1137): Hydroxyproline
  VARIANT (1138): Lys, Ser, Ala, Thr, Gly, or Val
  MOD_RES (1139): Hydroxyproline
  VARIANT (1140): Lys, Ser, Ala, Thr, Gly, or Val
  MOD_RES (1141): Hydroxyproline
  VARIANT (1142): Lys, Ser, Ala, Thr, Gly, or Val
  MOD_RES (1143): Hydroxyproline
  VARIANT (1144): Lys, Ser, Ala, Thr, Gly, or Val
  MOD_RES (1145): Hydroxyproline
  VARIANT (1146): Lys, Ser, Ala, Thr, Gly, or Val
  MOD_RES (1147): Hydroxyproline
  VARIANT (1148): Lys, Ser, Ala, Thr, Gly, or Val
  MOD_RES (1149): Hydroxyproline
  VARIANT (1150): Lys, Ser, Ala, Thr, Gly, or Val
  MOD_RES (1151): Hydroxyproline
  VARIANT (1152): Lys, Ser, Ala, Thr, Gly, or Val
  MOD_RES (1153): Hydroxyproline
  VARIANT (1154): Lys, Ser, Ala, Thr, Gly, or Val
  MOD_RES (1155): Hydroxyproline
  VARIANT (1156): Lys, Ser, Ala, Thr, Gly, or Val
  MOD_RES (1157): Hydroxyproline
  VARIANT (1158): Lys, Ser, Ala, Thr, Gly, or Val
  MOD_RES (1159): Hydroxyproline
  VARIANT (1160): Lys, Ser, Ala, Thr, Gly, or Val
  MOD_RES (1161): Hydroxyproline
  VARIANT (1162): Lys, Ser, Ala, Thr, Gly, or Val
  MOD_RES (1163): Hydroxyproline
  VARIANT (1164): Lys, Ser, Ala, Thr, Gly, or Val
  MOD_RES (1165): Hydroxyproline
  VARIANT (1166): Lys, Ser, Ala, Thr, Gly, or Val
  MOD_RES (1167): Hydroxyproline
  VARIANT (1168): Lys, Ser, Ala, Thr, Gly, or Val
  MOD_RES (1169): Hydroxyproline
  VARIANT (1170): Lys, Ser, Ala, Thr, Gly, or Val
  MOD_RES (1171): Hydroxyproline
  VARIANT (1172): Lys, Ser, Ala, Thr, Gly, or Val
  MOD_RES (1173): Hydroxyproline
  vARIANT (1174): Lys, Ser, Ala, Thr, Gly, or Val
  MOD_RES (1175): Hydroxyproline
  VARIANT (1176): Lys, Ser, Ala, Thr, Gly, or Val
  MOD_RES (1177): Hydroxyproline
  VARIANT (1178): Lys, Ser, Ala, Thr, Gly, or Val
  MOD_RES (1179): Hydroxyproline
  VARIANT (1180): Lys, Ser, Ala, Thr, Gly, or Val
  MOD_RES (1181): Hydroxyproline
  VARIANT (1182): Lys, Ser, Ala, Thr, Gly, or Val
  MOD_RES (1183): Hydroxyproline
  VARIANT (1184): Lys, Ser, Ala, Thr, Gly, or Val
  MOD_RES (1185): Hydroxyproline
  VARIANT (1186): Lys, Ser, Ala, Thr, Gly, or Val
  MOD_RES (1187): Hydroxyproline
  VARIANT (1188): Lys, Ser, Ala, Thr, Gly, or Val
  MOD_RES (1189): Hydroxyproline
  VARIANT (1190): Lys, Ser, Ala, Thr, Gly, or Val
  MOD_RES (1191): Hydroxyproline
  VARIANT (1192): Lys, Ser, Ala, Thr, Gly, or Val
  MOD_RES (1193): Hydroxyproline
  VARIANT (1194): Lys, Ser, Ala, Thr, Gly, or Val
  MOD_RES (1195): Hydroxyproline
  VARIANT (1196): Lys, Ser, Ala, Thr, Gly, or Val
  MOD_RES (1197): Hydroxyproline
  VARIANT (1198): Lys, Ser, Ala, Thr, Gly, or Val
  MOD_RES (1199): Hydroxyproline
  VARIANT (1200): Lys, Ser, Ala, Thr, Gly, or Val
  MOD_RES (1201): Hydroxyproline
  VARIANT (1202): Lys, Ser, Ala, Thr, Gly, or Val
  MOD_RES (1203): Hydroxyproline
  VARIANT (1204): Lys, Ser, Ala, Thr, Gly, or Val
  MOD_RES (1205): Hydroxyproline
  VARIANT (1206): Lys, Ser, Ala, Thr, Gly, or Val
  MOD_RES (1207): Hydroxyproline
  VARIANT (1208): Lys, Ser, Ala, Thr, Gly, or Val
  MOD_RES (1209): Hydroxyproline
  VARIANT (1210): Lys, Ser, Ala, Thr, Gly, or Val
  MOD_RES (1211): Hydroxyproline
  VARIANT (1212): Lys, Ser, Ala, Thr, Gly, or Val
  MOD_RES (1213): Hydroxyproline
  VARIANT (1214): Lys, Ser, Ala, Thr, Gly, or Val
  MOD_RES (1215): Hydroxyproline
  VARIANT (1216): Lys, Ser, Ala, Thr, Gly, or Val
  MOD_RES (1217): Hydroxyproline
  VARIANT (1218): Lys, Ser, Ala, Thr, Gly, or Val
  MOD_RES (1219): Hydroxyproline
  VARIANT (1220): Lys, Ser, Ala, Thr, Gly, or Val
  MOD_RES (1221): Hydroxyproline
  VARIANT (1222): Lys, Ser, Ala, Thr, Gly, or Val
  MOD_RES (1223): Hydroxyproline
  VARIANT (1224): Lys, Ser, Ala, Thr, Gly, or Val
  MOD_RES (1225): Hydroxyproline
  VARIANT (1226): Lys, Ser, Ala, Thr, Gly, or Val
  MOD_RES (1227): Hydroxyproline
  VARIANT (1228): Lys, Ser, Ala, Thr, Gly, or Val
  MOD_RES (1229): Hydroxyproline
  VARIANT (1230): Lys, Ser, Ala, Thr, Gly, or Val
  MOD_RES (1231): Hydroxyproline
  VARIANT (1232): Lys, Ser, Ala, Thr, Gly, or Val
  MOD_RES (1233): Hydroxyproline
  VARIANT (1234): Lys, Ser, Ala, Thr, Gly, or Val
  MOD_RES (1235): Hydroxyproline
  VARIANT (1236): Lys, Ser, Ala, Thr, Gly, or Val
  MOD_RES (1237): Hydroxyproline
  VARIANT (1238): Lys, Ser, Ala, Thr, Gly, or Val
  MOD_RES (1239): Hydroxyproline
  VARIANT (1240): Lys, Ser, Ala, Thr, Gly, or Val
  MOD_RES (1241): Hydroxyproline
  VARIANT (1242): Lys, Ser, Ala, Thr, Gly, or Val
  MOD_RES (1243): Hydroxyproline
  VARIANT (1244): Lys, Ser, Ala, Thr, Gly, or Val
  MOD_RES (1245): Hydroxyproline
  VARIANT (1246): Lys, Ser, Ala, Thr, Gly, or Val
  MOD_RES (1247): Hydroxyproline
  VARIANT (1248): Lys, Ser, Ala, Thr, Gly, or Val
  MOD_RES (1249): Hydroxyproline
  VARIANT (1250): Lys, Ser, Ala, Thr, Gly, or Val
  MOD_RES (1251): Hydroxyproline
  VARIANT (1252): Lys, Ser, Ala, Thr, Gly, or Val
  MOD_RES (1253): Hydroxyproline
  VARIANT (1254): Lys, Ser, Ala, Thr, Gly, or Val
  MOD_RES (1255): Hydroxyproline
  VARIANT (1256): Lys, Ser, Ala, Thr, Gly, or Val
  MOD_RES (1257): Hydroxyproline
  VARIANT (1258): Lys, Ser, Ala, Thr, Gly, or Val
  MOD_RES (1259): Hydroxyproline
  VARIANT (1260): Lys, Ser, Ala, Thr, Gly, or Val
  MOD_RES (1261): Hydroxyproline
  VARIANT (1262): Lys, Ser, Ala, Thr, Gly, or Val
  MOD_RES (1263): Hydroxyproline
  VARIANT (1264): Lys, Ser, Ala, Thr, Gly, or Val
  MOD_RES (1265): Hydroxyproline
  VARIANT (1266): Lys, Ser, Ala, Thr, Gly, or Val
  MOD_RES (1267): Hydroxyproline
  VARIANT (1268): Lys, Ser, Ala, Thr, Gly, or Val
  MOD_RES (1269): Hydroxyproline
  VARIANT (1270): Lys, Ser, Ala, Thr, Gly, or Val
  MOD_RES (1271): Hydroxyproline
  VARIANT (1272): Lys, Ser, Ala, Thr, Gly, or Val
  MOD_RES (1273): Hydroxyproline
  VARIANT (1274): Lys, Ser, Ala, Thr, Gly, or Val
  MOD_RES (1275): Hydroxyproline
  VARIANT (1276): Lys, Ser, Ala, Thr, Gly, or Val
  MOD_RES (1277): Hydroxyproline
  VARIANT (1278): Lys, Ser, Ala, Thr, Gly, or Val
  MOD_RES (1279): Hydroxyproline
  VARIANT (1280): Lys, Ser, Ala, Thr, Gly, or Val
  MOD_RES (1281): Hydroxyproline
  VARIANT (1282): Lys, Ser, Ala, Thr, Gly, or Val
  MOD_RES (1283): Hydroxyproline
  VARIANT (1284): Lys, Ser, Ala, Thr, Gly, or Val
  MOD_RES (1285): Hydroxyproline
  VARIANT (1286): Lys, Ser, Ala, Thr, Gly, or Val
  MOD_RES (1287): Hydroxyproline
  VARIANT (1288): Lys, Ser, Ala, Thr, Gly, or Val
  MOD_RES (1289): Hydroxyproline
  VARIANT (1290): Lys, Ser, Ala, Thr, Gly, or Val
  MOD_RES (1291): Hydroxyproline
  VARIANT (1292): Lys, Ser, Ala, Thr, Gly, or Val
  MOD_RES (1293): Hydroxyproline
  VARIANT (1294): Lys, Ser, Ala, Thr, Gly, or Val
  MOD_RES (1295): Hydroxyproline
  VARIANT (1296): Lys, Ser, Ala, Thr, Gly, or Val
  MOD_RES (1297): Hydroxyproline
  VARIANT (1298): Lys, Ser, Ala, Thr, Gly, or Val
  MOD_RES (1299): Hydroxyproline
  VARIANT (1300): Lys, Ser, Ala, Thr, Gly, or Val
  MOD_RES (1301): Hydroxyproline
  VARIANT (1302): Lys, Ser, Ala, Thr, Gly, or Val
  MOD_RES (1303): Hydroxyproline
  VARIANT (1304): Lys, Ser, Ala, Thr, Gly, or Val
  MOD_RES (1305): Hydroxyproline
  VARIANT (1306): Lys, Ser, Ala, Thr, Gly, or Val
  MOD_RES (1307): Hydroxyproline
  VARIANT (1308): Lys, Ser, Ala, Thr, Gly, or Val
  MOD_RES (1309): Hydroxyproline
  VARIANT (1310): Lys, Ser, Ala, Thr, Gly, or Val
  MOD_RES (1311): Hydroxyproline
  VARIANT (1312): Lys, Ser, Ala, Thr, Gly, or Val
  MOD_RES (1313): Hydroxyproline
  VARIANT (1314): Lys, Ser, Ala, Thr, Gly, or Val
  MOD_RES (1315): Hydroxyproline
  VARIANT (1316): Lys, Ser, Ala, Thr, Gly, or Val
  MOD_RES (1317): Hydroxyproline
  VARIANT (1318): Lys, Ser, Ala, Thr, Gly, or Val
  MOD_RES (1319): Hydroxyproline
  VARIANT (1320): Lys, Ser, Ala, Thr, Gly, or Val
  MOD_RES (1321): Hydroxyproline
  VARIANT (1322): Lys, Ser, Ala, Thr, Gly, or Val
  MOD_RES (1323): Hydroxyproline
  VARIANT (1324): Lys, Ser, Ala, Thr, Gly, or Val
  MOD_RES (1325): Hydroxyproline
  VARIANT (1326): Lys, Ser, Ala, Thr, Gly, or Val
  MOD_RES (1327): Hydroxyproline
  VARIANT (1328): Lys, Ser, Ala, Thr, Gly, or Val
  MOD_RES (1329): Hydroxyproline
  VARIANT (1330): Lys, Ser, Ala, Thr, Gly, or Val
  MOD_RES (1331): Hydroxyproline
  VARIANT (1332): Lys, Ser, Ala, Thr, Gly, or Val
  MOD_RES (1333): Hydroxyproline
  VARIANT (1334): Lys, Ser, Ala, Thr, Gly, or Val
  MOD_RES (1335): Hydroxyproline
  VARIANT (1336): Lys, Ser, Ala, Thr, Gly, or Val
  MOD_RES (1337): Hydroxyproline
  VARIANT (1338): Lys, Ser, Ala, Thr, Gly, or Val
  MOD_RES (1339): Hydroxyproline
  VARIANT (1340): Lys, Ser, Ala, Thr, Gly, or Val
  MOD_RES (1341): Hydroxyproline
  VARIANT (1342): Lys, Ser, Ala, Thr, Gly, or Val
  MOD_RES (1343): Hydroxyproline
  VARIANT (1344): Lys, Ser, Ala, Thr, Gly, or Val
  MOD_RES (1345): Hydroxyproline
  VARIANT (1346): Lys, Ser, Ala, Thr, Gly, or Val
  MOD_RES (1347): Hydroxyproline
  VARIANT (1348): Lys, Ser, Ala, Thr, Gly, or Val
  MOD_RES (1349): Hydroxyproline
  VARIANT (1350): Lys, Ser, Ala, Thr, Gly, or Val
  MOD_RES (1351): Hydroxyproline
  VARIANT (1352): Lys, Ser, Ala, Thr, Gly, or Val
  MOD_RES (1353): Hydroxyproline
  VARIANT (1354): Lys, Ser, Ala, Thr, Gly, or Val
  MOD_RES (1355): Hydroxyproline
  VARIANT (1356): Lys, Ser, Ala, Thr, Gly, or Val
  MOD_RES (1357): Hydroxyproline
  VARIANT (1358): Lys, Ser, Ala, Thr, Gly, or Val
  MOD_RES (1359): Hydroxyproline
  VARIANT (1360): Lys, Ser, Ala, Thr, Gly, or Val
  MOD_RES (1361): Hydroxyproline
  VARIANT (1362): Lys, Ser, Ala, Thr, Gly, or Val
  MOD_RES (1363): Hydroxyproline
  VARIANT (1364): Lys, Ser, Ala, Thr, Gly, or Val
  MOD_RES (1365): Hydroxyproline
  VARIANT (1366): Lys, Ser, Ala, Thr, Gly, or Val
  MOD_RES (1367): Hydroxyproline
  VARIANT (1368): Lys, Ser, Ala, Thr, Gly, or Val
  MOD_RES (1369): Hydroxyproline
  VARIANT (1370): Lys, Ser, Ala, Thr, Gly, or Val
  MOD_RES (1371): Hydroxyproline
  VARIANT (1372): Lys, Ser, Ala, Thr, Gly, or Val
  MOD_RES (1373): Hydroxyproline
  VARIANT (1374): Lys, Ser, Ala, Thr, Gly, or Val
  MOD_RES (1375): Hydroxyproline
  VARIANT (1376): Lys, Ser, Ala, Thr, Gly, or Val
  MOD_RES (1377): Hydroxyproline
  VARIANT (1378): Lys, Ser, Ala, Thr, Gly, or Val
  MOD_RES (1379): Hydroxyproline
  VARIANT (1380): Lys, Ser, Ala, Thr, Gly, or Val
  MOD_RES (1381): Hydroxyproline
  VARIANT (1382): Lys, Ser, Ala, Thr, Gly, or Val
  MOD_RES (1383): Hydroxyproline
  VARIANT (1384): Lys, Ser, Ala, Thr, Gly, or Val
  MOD_RES (1385): Hydroxyproline
  VARIANT (1386): Lys, Ser, Ala, Thr, Gly, or Val
  MOD_RES (1387): Hydroxyproline
  VARIANT (1388): Lys, Ser, Ala, Thr, Gly, or Val
  MOD_RES (1389): Hydroxyproline
  VARIANT (1390): Lys, Ser, Ala, Thr, Gly, or Val
  MOD_RES (1391): Hydroxyproline
  VARIANT (1392): Lys, Ser, Ala, Thr, Gly, or Val
  MOD_RES (1393): Hydroxyproline
  VARIANT (1394): Lys, Ser, Ala, Thr, Gly, or Val
  MOD_RES (1395): Hydroxyproline
  VARIANT (1396): Lys, Ser, Ala, Thr, Gly, or Val
  MOD_RES (1397): Hydroxyproline
  VARIANT (1398): Lys, Ser, Ala, Thr, Gly, or Val
  MOD_RES (1399): Hydroxyproline
  VARIANT (1400): Lys, Ser, Ala, Thr, Gly, or Val
  MOD_RES (1401): Hydroxyproline
  VARIANT (1402): Lys, Ser, Ala, Thr, Gly, or Val
  MOD_RES (1403): Hydroxyproline
  VARIANT (1404): Lys, Ser, Ala, Thr, Gly, or Val
  MOD_RES (1405): Hydroxyproline
  VARIANT (1406): Lys, Ser, Ala, Thr, Gly, or Val
  MOD_RES (1407): Hydroxyproline
  VARIANT (1408): Lys, Ser, Ala, Thr, Gly, or Val
  MOD_RES (1409): Hydroxyproline
  VARIANT (1410): Lys, Ser, Ala, Thr, Gly, or Val
  MOD_RES (1411): Hydroxyproline
  VARIANT (1412): Lys, Ser, Ala, Thr, Gly, or Val
  MOD_RES (1413): Hydroxyproline
  VARIANT (1414): Lys, Ser, Ala, Thr, Gly, or Val
  MOD_RES (1415): Hydroxyproline
  VARIANT (1416): Lys, Ser, Ala, Thr, Gly, or Val
  MOD_RES (1417): Hydroxyproline
  VARIANT (1418): Lys, Ser, Ala, Thr, Gly, or Val
  MOD_RES (1419): Hydroxyproline
  VARIANT (1420): Lys, Ser, Ala, Thr, Gly, or Val
  MOD_RES (1421): Hydroxyproline
  VARIANT (1422): Lys, Ser, Ala, Thr, Gly, or Val
  MOD_RES (1423): Hydroxyproline
  VARIANT (1424): Lys, Ser, Ala, Thr, Gly, or Val
  MOD_RES (1425): Hydroxyproline
  VARIANT (1426): Lys, Ser, Ala, Thr, Gly, or Val
  MOD_RES (1427): Hydroxyproline
  VARIANT (1428): Lys, Ser, Ala, Thr, Gly, or Val
  MOD_RES (1429): Hydroxyproline
  VARIANT (1430): Lys, Ser, Ala, Thr, Gly, or Val
  MOD_RES (1431): Hydroxyproline
  VARIANT (1432): Lys, Ser, Ala, Thr, Gly, or Val
  MOD_RES (1433): Hydroxyproline
  VARIANT (1434): Lys, Ser, Ala, Thr, Gly, or Val
  MOD_RES (1435): Hydroxyproline
  VARIANT (1436): Lys, Ser, Ala, Thr, Gly, or Val
  MOD_RES (1437): Hydroxyproline
  VARIANT (1438): Lys, Ser, Ala, Thr, Gly, or Val
  MOD_RES (1439): Hydroxyproline
  VARIANT (1440): Lys, Ser, Ala, Thr, Gly, or Val
  MOD_RES (1441): Hydroxyproline
  VARIANT (1442): Lys, Ser, Ala, Thr, Gly, or Val
  MOD_RES (1443): Hydroxyproline
  VARIANT (1444): Lys, Ser, Ala, Thr, Gly, or Val
  MOD_RES (1445): Hydroxyproline
  VARIANT (1446): Lys, Ser, Ala, Thr, Gly, or Val
  MOD_RES (1447): Hydroxyproline
  VARIANT (1448): Lys, Ser, Ala, Thr, Gly, or Val
  MOD_RES (1449): Hydroxyproline
  VARIANT (1450): Lys, Ser, Ala, Thr, Gly, or Val
  MOD_RES (1451): Hydroxyproline
  VARIANT (1452): Lys, Ser, Ala, Thr, Gly, or Val
  MOD_RES (1453): Hydroxyproline
  VARIANT (1454): Lys, Ser, Ala, Thr, Gly, or Val
  MOD_RES (1455): Hydroxyproline
  VARIANT (1456): Lys, Ser, Ala, Thr, Gly, or Val
  MOD_RES (1457): Hydroxyproline
  VARIANT (1458): Lys, Ser, Ala, Thr, Gly, or Val
  MOD_RES (1459): Hydroxyproline
  VARIANT (1460): Lys, Ser, Ala, Thr, Gly, or Val
  MOD_RES (1461): Hydroxyproline
  VARIANT (1462): Lys, Ser, Ala, Thr, Gly, or Val
  MOD_RES (1463): Hydroxyproline
  VARIANT (1464): Lys, Ser, Ala, Thr, Gly, or Val
  MOD_RES (1465): Hydroxyproline
  VARIANT (1466): Lys, Ser, Ala, Thr, Gly, or Val
  MOD_RES (1467): Hydroxyproline
  VARIANT (1468): Lys, Ser, Ala, Thr, Gly, or Val
  MOD_RES (1469): Hydroxyproline
  VARIANT (1470): Lys, Ser, Ala, Thr, Gly, or Val
  MOD_RES (1471): Hydroxyproline
  VARIANT (1472): Lys, Ser, Ala, Thr, Gly, or Val
  MOD_RES (1473): Hydroxyproline
  VARIANT (1474): Lys, Ser, Ala, Thr, Gly, or Val
  MOD_RES (1475): Hydroxyproline
  VARIANT (1476): Lys, Ser, Ala, Thr, Gly, or Val
  MOD_RES (1477): Hydroxyproline
  VARIANT (1478): Lys, Ser, Ala, Thr, Gly, or Val
  MOD_RES (1479): Hydroxyproline
  VARIANT (1480): Lys, Ser, Ala, Thr, Gly, or Val
  MOD_RES (1481): Hydroxyproline
  VARIANT (1482): Lys, Ser, Ala, Thr, Gly, or Val
  MOD_RES (1483): Hydroxyproline
  VARIANT (1484): Lys, Ser, Ala, Thr, Gly, or Val
  MOD_RES (1485): Hydroxyproline
  VARIANT (1486): Lys, Ser, Ala, Thr, Gly, or Val
  MOD_RES (1487): Hydroxyproline
  VARIANT (1488): Lys, Ser, Ala, Thr, Gly, or Val
  MOD_RES (1489): Hydroxyproline
  VARIANT (1490): Lys, Ser, Ala, Thr, Gly, or Val
  MOD_RES (1491): Hydroxyproline
  VARIANT (1492): Lys, Ser, Ala, Thr, Gly, or Val
  MOD_RES (1493): Hydroxyproline
  VARIANT (1494): Lys, Ser, Ala, Thr, Gly, or Val
  MOD_RES (1495): Hydroxyproline
  VARIANT (1496): Lys, Ser, Ala, Thr, Gly, or Val
  MOD_RES (1497): Hydroxyproline
  VARIANT (1498): Lys, Ser, Ala, Thr, Gly, or Val
  MOD_RES (1499): Hydroxyproline
  VARIANT (1500): Lys, Ser, Ala, Thr, Gly, or Val
  MOD_RES (1501): Hydroxyproline
  VARIANT (1502): Lys, Ser, Ala, Thr, Gly, or Val
  MOD_RES (1503): Hydroxyproline
  VARIANT (1504): Lys, Ser, Ala, Thr, Gly, or Val
  MOD_RES (1505): Hydroxyproline
  VARIANT (1506): Lys, Ser, Ala, Thr, Gly, or Val
  MOD_RES (1507): Hydroxyproline
  VARIANT (1508): Lys, Ser, Ala, Thr, Gly, or Val
  MOD_RES (1509): Hydroxyproline
  VARIANT (1510): Lys, Ser, Ala, Thr, Gly, or Val
  MOD_RES (1511): Hydroxyproline
  VARIANT (1512): Lys, Ser, Ala, Thr, Gly, or Val
  MOD_RES (1513): Hydroxyproline
  VARIANT (1514): Lys, Ser, Ala, Thr, Gly, or Val
  MOD_RES (1515): Hydroxyproline
  VARIANT (1516): Lys, Ser, Ala, Thr, Gly, or Val
  MOD_RES (1517): Hydroxyproline
  VARIANT (1518): Lys, Ser, Ala, Thr, Gly, or Val
  MOD_RES (1519): Hydroxyproline
  VARIANT (1520): Lys, Ser, Ala, Thr, Gly, or Val
  MOD_RES (1521): Hydroxyproline
  VARIANT (1522): Lys, Ser, Ala, Thr, Gly, or Val
  MOD_RES (1523): Hydroxyproline
  VARIANT (1524): Lys, Ser, Ala, Thr, Gly, or Val
  MOD_RES (1525): Hydroxyproline
  VARIANT (1526): Lys, Ser, Ala, Thr, Gly, or Val
  MOD_RES (1527): Hydroxyproline
  VARIANT (1528): Lys, Ser, Ala, Thr, Gly, or Val
  MOD_RES (1529): Hydroxyproline
  VARIANT (1530): Lys, Ser, Ala, Thr, Gly, or Val
  MOD_RES (1531): Hydroxyproline
  VARIANT (1532): Lys, Ser, Ala, Thr, Gly, or Val
  MOD_RES (1533): Hydroxyproline
  VARIANT (1534): Lys, Ser, Ala, Thr, Gly, or Val
  MOD_RES (1535): Hydroxyproline
  VARIANT (1536): Lys, Ser, Ala, Thr, Gly, or Val
  MOD_RES (1537): Hydroxyproline
  VARIANT (1538): Lys, Ser, Ala, Thr, Gly, or Val
  MOD_RES (1539): Hydroxyproline
  VARIANT (1540): Lys, Ser, Ala, Thr, Gly, or Val
  MOD_RES (1541): Hydroxyproline
  VARIANT (1542): Lys, Ser, Ala, Thr, Gly, or Val
  MOD_RES (1543): Hydroxyproline
  VARIANT (1544): Lys, Ser, Ala, Thr, Gly, or Val
  MOD_RES (1545): Hydroxyproline
  VARIANT (1546): Lys, Ser, Ala, Thr, Gly, or Val
  MOD_RES (1547): Hydroxyproline
  VARIANT (1548): Lys, Ser, Ala, Thr, Gly, or Val
  MOD_RES (1549): Hydroxyproline
  VARIANT (1550): Lys, Ser, Ala, Thr, Gly, or Val
  MOD_RES (1551): Hydroxyproline
  VARIANT (1552): Lys, Ser, Ala, Thr, Gly, or Val
  MOD_RES (1553): Hydroxyproline
  VARIANT (1554): Lys, Ser, Ala, Thr, Gly, or Val
  MOD_RES (1555): Hydroxyproline
  VARIANT (1556): Lys, Ser, Ala, Thr, Gly, or Val
  MOD_RES (1557): Hydroxyproline
  VARIANT (1558): Lys, Ser, Ala, Thr, Gly, or Val
  MOD_RES (1559): Hydroxyproline
  VARIANT (1560): Lys, Ser, Ala, Thr, Gly, or Val
  MOD_RES (1561): Hydroxyproline
  VARIANT (1562): Lys, Ser, Ala, Thr, Gly, or Val
  MOD_RES (1563): Hydroxyproline
  VARIANT (1564): Lys, Ser, Ala, Thr, Gly, or Val
  MOD_RES (1565): Hydroxyproline
  VARIANT (1566): Lys, Ser, Ala, Thr, Gly, or Val
  MOD_RES (1567): Hydroxyproline
  VARIANT (1568): Lys, Ser, Ala, Thr, Gly, or Val
  MOD_RES (1569): Hydroxyproline
  VARIANT (1570): Lys, Ser, Ala, Thr, Gly, or Val
  MOD_RES (1571): Hydroxyproline
  VARIANT (1572): Lys, Ser, Ala, Thr, Gly, or Val
  MOD_RES (1573): Hydroxyproline
  VARIANT (1574): Lys, Ser, Ala, Thr, Gly, or Val
  MOD_RES (1575): Hydroxyproline
  VARIANT (1576): Lys, Ser, Ala, Thr, Gly, or Val
  MOD_RES (1577): Hydroxyproline
  VARIANT (1578): Lys, Ser, Ala, Thr, Gly, or Val
  MOD_RES (1579): Hydroxyproline
  VARIANT (1580): Lys, Ser, Ala, Thr, Gly, or Val
  MOD_RES (1581): Hydroxyproline
  VARIANT (1582): Lys, Ser, Ala, Thr, Gly, or Val
  MOD_RES (1583): Hydroxyproline
  VARIANT (1584): Lys, Ser, Ala, Thr, Gly, or Val
  MOD_RES (1585): Hydroxyproline
  VARIANT (1586): Lys, Ser, Ala, Thr, Gly, or Val
  MOD_RES (1587): Hydroxyproline
  VARIANT (1588): Lys, Ser, Ala, Thr, Gly, or Val
  MOD_RES (1589): Hydroxyproline
  VARIANT (1590): Lys, Ser, Ala, Thr, Gly, or Val
  MOD_RES (1591): Hydroxyproline
  VARIANT (1592): Lys, Ser, Ala, Thr, Gly, or Val
  MOD_RES (1593): Hydroxyproline
  VARIANT (1594): Lys, Ser, Ala, Thr, Gly, or Val
  MOD_RES (1595): Hydroxyproline
  VARIANT (1596): Lys, Ser, Ala, Thr, Gly, or Val
  MOD_RES (1597): Hydroxyproline
  VARIANT (1598): Lys, Ser, Ala, Thr, Gly, or Val
  MOD_RES (1599): Hydroxyproline
  VARIANT (1600): Lys, Ser, Ala, Thr, Gly, or Val
  MOD_RES (1601): Hydroxyproline
  VARIANT (1602): Lys, Ser, Ala, Thr, Gly, or Val
  MOD_RES (1603): Hydroxyproline
  VARIANT (1604): Lys, Ser, Ala, Thr, Gly, or Val
  MOD_RES (1605): Hydroxyproline
  VARIANT (1606): Lys, Ser, Ala, Thr, Gly, or Val
  MOD_RES (1607): Hydroxyproline
  VARIANT (1608): Lys, Ser, Ala, Thr, Gly, or Val
  MOD_RES (1609): Hydroxyproline
  VARIANT (1610): Lys, Ser, Ala, Thr, Gly, or Val
  MOD_RES (1611): Hydroxyproline
  VARIANT (1612): Lys, Ser, Ala, Thr, Gly, or Val
  MOD_RES (1613): Hydroxyproline
  VARIANT (1614): Lys, Ser, Ala, Thr, Gly, or Val
  MOD_RES (1615): Hydroxyproline
  VARIANT (1616): Lys, Ser, Ala, Thr, Gly, or Val
  MOD_RES (1617): Hydroxyproline
  VARIANT (1618): Lys, Ser, Ala, Thr, Gly, or Val
  MOD_RES (1619): Hydroxyproline
  VARIANT (1620): Lys, Ser, Ala, Thr, Gly, or Val
  MOD_RES (1621): Hydroxyproline
  VARIANT (1622): Lys, Ser, Ala, Thr, Gly, or Val
  MOD_RES (1623): Hydroxyproline
  VARIANT (1624): Lys, Ser, Ala, Thr, Gly, or Val
  MOD_RES (1625): Hydroxyproline
  VARIANT (1626): Lys, Ser, Ala, Thr, Gly, or Val
  MOD_RES (1627): Hydroxyproline
  VARIANT (1628): Lys, Ser, Ala, Thr, Gly, or Val
  MOD_RES (1629): Hydroxyproline
  VARIANT (1630): Lys, Ser, Ala, Thr, Gly, or Val
  MOD_RES (1631): Hydroxyproline
  VARIANT (1632): Lys, Ser, Ala, Thr, Gly, or Val
  MOD_RES (1633): Hydroxyproline
  VARIANT (1634): Lys, Ser, Ala, Thr, Gly, or Val
  MOD_RES (1635): Hydroxyproline
  VARIANT (1636): Lys, Ser, Ala, Thr, Gly, or Val
  MOD_RES (1637): Hydroxyproline
  VARIANT (1638): Lys, Ser, Ala, Thr, Gly, or Val
  MOD_RES (1639): Hydroxyproline
  VARIANT (1640): Lys, Ser, Ala, Thr, Gly, or Val
  MOD_RES (1641): Hydroxyproline
  VARIANT (1642): Lys, Ser, Ala, Thr, Gly, or Val
  MOD_RES (1643): Hydroxyproline
  VARIANT (1644): Lys, Ser, Ala, Thr, Gly, or Val
  MOD_RES (1645): Hydroxyproline
  VARIANT (1646): Lys, Ser, Ala, Thr, Gly, or Val
  MOD_RES (1647): Hydroxyproline
  VARIANT (1648): Lys, Ser, Ala, Thr, Gly, or Val
  MOD_RES (1649): Hydroxyproline
  VARIANT (1650): Lys, Ser, Ala, Thr, Gly, or Val
  MOD_RES (1651): Hydroxyproline
  VARIANT (1652): Lys, Ser, Ala, Thr, Gly, or Val
  MOD_RES (1653): Hydroxyproline
  VARIANT (1654): Lys, Ser, Ala, Thr, Gly, or Val
  MOD_RES (1655): Hydroxyproline
  VARIANT (1656): Lys, Ser, Ala, Thr, Gly, or Val
  MOD_RES (1657): Hydroxyproline
  VARIANT (1658): Lys, Ser, Ala, Thr, Gly, or Val
  MOD_RES (1659): Hydroxyproline
  VARIANT (1660): Lys, Ser, Ala, Thr, Gly, or Val
  MOD_RES (1661): Hydroxyproline
  VARIANT (1662): Lys, Ser, Ala, Thr, Gly, or Val
  MOD_RES (1663): Hydroxyproline
  VARIANT (1664): Lys, Ser, Ala, Thr, Gly, or Val
  MOD_RES (1665): Hydroxyproline
  VARIANT (1666): Lys, Ser, Ala, Thr, Gly, or Val
  MOD_RES (1667): Hydroxyproline
  VARIANT (1668): Lys, Ser, Ala, Thr, Gly, or Val
  MOD_RES (1669): Hydroxyproline
  VARIANT (1670): Lys, Ser, Ala, Thr, Gly, or Val
  MOD_RES (1671): Hydroxyproline
  VARIANT (1672): Lys, Ser, Ala, Thr, Gly, or Val
  MOD_RES (1673): Hydroxyproline
  VARIANT (1674): Lys, Ser, Ala, Thr, Gly, or Val
  MOD_RES (1675): Hydroxyproline
  VARIANT (1676): Lys, Ser, Ala, Thr, Gly, or Val
  MOD_RES (1677): Hydroxyproline
  VARIANT (1678): Lys, Ser, Ala, Thr, Gly, or Val
  MOD_RES (1679): Hydroxyproline
  VARIANT (1680): Lys, Ser, Ala, Thr, Gly, or Val
  MOD_RES (1681): Hydroxyproline
  VARIANT (1682): Lys, Ser, Ala, Thr, Gly, or Val
  MOD_RES (1683): Hydroxyproline
  VARIANT (1684): Lys, Ser, Ala, Thr, Gly, or Val
  MOD_RES (1685): Hydroxyproline
  VARIANT (1686): Lys, Ser, Ala, Thr, Gly, or Val
  MOD_RES (1687): Hydroxyproline
  VARIANT (1688): Lys, Ser, Ala, Thr, Gly, or Val
  MOD_RES (1689): Hydroxyproline
  VARIANT (1690): Lys, Ser, Ala, Thr, Gly, or Val
  MOD_RES (1691): Hydroxyproline
  VARIANT (1692): Lys, Ser, Ala, Thr, Gly, or Val
  MOD_RES (1693): Hydroxyproline
  VARIANT (1694): Lys, Ser, Ala, Thr, Gly, or Val
  MOD_RES (1695): Hydroxyproline
  VARIANT (1696): Lys, Ser, Ala, Thr, Gly, or Val
  MOD_RES (1697): Hydroxyproline
  VARIANT (1698): Lys, Ser, Ala, Thr, Gly, or Val
  MOD_RES (1699): Hydroxyproline
  VARIANT (1700): Lys, Ser, Ala, Thr, Gly, or Val
  MOD_RES (1701): Hydroxyproline
  VARIANT (1702): Lys, Ser, Ala, Thr, Gly, or Val
  MOD_RES (1703): Hydroxyproline
  VARIANT (1704): Lys, Ser, Ala, Thr, Gly, or Val
  MOD_RES (1705): Hydroxyproline
  VARIANT (1706): Lys, Ser, Ala, Thr, Gly, or Val
  MOD_RES (1707): Hydroxyproline
  VARIANT (1708): Lys, Ser, Ala, Thr, Gly, or Val
  MOD_RES (1709): Hydroxyproline
  VARIANT (1710): Lys, Ser, Ala, Thr, Gly, or Val
  MOD_RES (1711): Hydroxyproline
  VARIANT (1712): Lys, Ser, Ala, Thr, Gly, or Val
  MOD_RES (1713): Hydroxyproline
  VARIANT (1714): Lys, Ser, Ala, Thr, Gly, or Val
  MOD_RES (1715): Hydroxyproline
  VARIANT (1716): Lys, Ser, Ala, Thr, Gly, or Val
  MOD_RES (1717): Hydroxyproline
  VARIANT (1718): Lys, Ser, Ala, Thr, Gly, or Val
  MOD_RES (1719): Hydroxyproline
  VARIANT (1720): Lys, Ser, Ala, Thr, Gly, or Val
  MOD_RES (1721): Hydroxyproline
  VARIANT (1722): Lys, Ser, Ala, Thr, Gly, or Val
  MOD_RES (1723): Hydroxyproline
  VARIANT (1724): Lys, Ser, Ala, Thr, Gly, or Val
  MOD_RES (1725): Hydroxyproline
  VARIANT (1726): Lys, Ser, Ala, Thr, Gly, or Val
  MOD_RES (1727): Hydroxyproline
  VARIANT (1728): Lys, Ser, Ala, Thr, Gly, or Val
  MOD_RES (1729): Hydroxyproline
  VARIANT (1730): Lys, Ser, Ala, Thr, Gly, or Val
  MOD_RES (1731): Hydroxyproline
  VARIANT (1732): Lys, Ser, Ala, Thr, Gly, or Val
  MOD_RES (1733): Hydroxyproline
  VARIANT (1734): Lys, Ser, Ala, Thr, Gly, or Val
  MOD_RES (1735): Hydroxyproline
  VARIANT (1736): Lys, Ser, Ala, Thr, Gly, or Val
  MOD_RES (1737): Hydroxyproline
  VARIANT (1738): Lys, Ser, Ala, Thr, Gly, or Val
  MOD_RES (1739): Hydroxyproline
  VARIANT (1740): Lys, Ser, Ala, Thr, Gly, or Val
  MOD_RES (1741): Hydroxyproline
  VARIANT (1742): Lys, Ser, Ala, Thr, Gly, or Val
  MOD_RES (1743): Hydroxyproline
  VARIANT (1744): Lys, Ser, Ala, Thr, Gly, or Val
  MOD_RES (1745): Hydroxyproline
  VARIANT (1746): Lys, Ser, Ala, Thr, Gly, or Val
  MOD_RES (1747): Hydroxyproline
  VARIANT (1748): Lys, Ser, Ala, Thr, Gly, or Val
  MOD_RES (1749): Hydroxyproline
  VARIANT (1750): Lys, Ser, Ala, Thr, Gly, or Val
  MOD_RES (1751): Hydroxyproline
  VARIANT (1752): Lys, Ser, Ala, Thr, Gly, or Val
  MOD_RES (1753): Hydroxyproline
  VARIANT (1754): Lys, Ser, Ala, Thr, Gly, or Val
  MOD_RES (1755): Hydroxyproline
  VARIANT (1756): Lys, Ser, Ala, Thr, Gly, or Val
  MOD_RES (1757): Hydroxyproline
  VARIANT (1758): Lys, Ser, Ala, Thr, Gly, or Val
  MOD_RES (1759): Hydroxyproline
  VARIANT (1760): Lys, Ser, Ala, Thr, Gly, or Val
  MOD_RES (1761): Hydroxyproline
  VARIANT (1762): Lys, Ser, Ala, Thr, Gly, or Val
  MOD_RES (1763): Hydroxyproline
  VARIANT (1764): Lys, Ser, Ala, Thr, Gly, or Val
  MOD_RES (1765): Hydroxyproline
  VARIANT (1766): Lys, Ser, Ala, Thr, Gly, or Val
  MOD_RES (1767): Hydroxyproline
  VARIANT (1768): Lys, Ser, Ala, Thr, Gly, or Val
  MOD_RES (1769): Hydroxyproline
  VARIANT (1770): Lys, Ser, Ala, Thr, Gly, or Val
  MOD_RES (1771): Hydroxyproline
  VARIANT (1772): Lys, Ser, Ala, Thr, Gly, or Val
  MOD_RES (1773): Hydroxyproline
  VARIANT (1774): Lys, Ser, Ala, Thr, Gly, or Val
  MOD_RES (1775): Hydroxyproline
  VARIANT (1776): Lys, Ser, Ala, Thr, Gly, or Val
  MOD_RES (1777): Hydroxyproline
  VARIANT (1778): Lys, Ser, Ala, Thr, Gly, or Val
  MOD_RES (1779): Hydroxyproline
  VARIANT (1780): Lys, Ser, Ala, Thr, Gly, or Val
  MOD_RES (1781): Hydroxyproline
  VARIANT (1782): Lys, Ser, Ala, Thr, Gly, or Val
  MOD_RES (1783): Hydroxyproline
  VARIANT (1784): Lys, Ser, Ala, Thr, Gly, or Val
  MOD_RES (1785): Hydroxyproline
  VARIANT (1786): Lys, Ser, Ala, Thr, Gly, or Val
  MOD_RES (1787): Hydroxyproline
  VARIANT (1788): Lys, Ser, Ala, Thr, Gly, or Val
  MOD_RES (1789): Hydroxyproline
  VARIANT (1790): Lys, Ser, Ala, Thr, Gly, or Val
  MOD_RES (1791): Hydroxyproline
  VARIANT (1792): Lys, Ser, Ala, Thr, Gly, or Val
  MOD_RES (1793): Hydroxyproline
  VARIANT (1794): Lys, Ser, Ala, Thr, Gly, or Val
  MOD_RES (1795): Hydroxyproline
  VARIANT (1796): Lys, Ser, Ala, Thr, Gly, or Val
  MOD_RES (1797): Hydroxyproline
  VARIANT (1798): Lys, Ser, Ala, Thr, Gly, or Val
  MOD_RES (1799): Hydroxyproline
  VARIANT (1800): Lys, Ser, Ala, Thr, Gly, or Val
  MOD_RES (1801): Hydroxyproline
  VARIANT (1802): Lys, Ser, Ala, Thr, Gly, or Val
  MOD_RES (1803): Hydroxyproline
  VARIANT (1804): Lys, Ser, Ala, Thr, Gly, or Val
  MOD_RES (1805): Hydroxyproline
  VARIANT (1806): Lys, Ser, Ala, Thr, Gly, or Val
  MOD_RES (1807): Hydroxyproline
  VARIANT (1808): Lys, Ser, Ala, Thr, Gly, or Val
  MOD_RES (1809): Hydroxyproline
  VARIANT (1810): Lys, Ser, Ala, Thr, Gly, or Val
  MOD_RES (1811): Hydroxyproline
  VARIANT (1812): Lys, Ser, Ala, Thr, Gly, or Val
  MOD_RES (1813): Hydroxyproline
  VARIANT (1814): Lys, Ser, Ala, Thr, Gly, or Val
  MOD_RES (1815): Hydroxyproline
  VARIANT (1816): Lys, Ser, Ala, Thr, Gly, or Val
  MOD_RES (1817): Hydroxyproline
  VARIANT (1818): Lys, Ser, Ala, Thr, Gly, or Val
  MOD_RES (1819): Hydroxyproline
  VARIANT (1820): Lys, Ser, Ala, Thr, Gly, or Val
  MOD_RES (1821): Hydroxyproline
  VARIANT (1822): Lys, Ser, Ala, Thr, Gly, or Val
  MOD_RES (1823): Hydroxyproline
  VARIANT (1824): Lys, Ser, Ala, Thr, Gly, or Val
  MOD_RES (1825): Hydroxyproline
  VARIANT (1826): Lys, Ser, Ala, Thr, Gly, or Val
  MOD_RES (1827): Hydroxyproline
  VARIANT (1828): Lys, Ser, Ala, Thr, Gly, or Val
  MOD_RES (1829): Hydroxyproline
  VARIANT (1830): Lys, Ser, Ala, Thr, Gly, or Val
  MOD_RES (1831): Hydroxyproline
  VARIANT (1832): Lys, Ser, Ala, Thr, Gly, or Val
  MOD_RES (1833): Hydroxyproline
  VARIANT (1834): Lys, Ser, Ala, Thr, Gly, or Val
  MOD_RES (1835): Hydroxyproline
  VARIANT (1836): Lys, Ser, Ala, Thr, Gly, or Val
  MOD_RES (1837): Hydroxyproline
  VARIANT (1838): Lys, Ser, Ala, Thr, Gly, or Val
  MOD_RES (1839): Hydroxyproline
  VARIANT (1840): Lys, Ser, Ala, Thr, Gly, or Val
  MOD_RES (1841): Hydroxyproline
  VARIANT (1842): Lys, Ser, Ala, Thr, Gly, or Val
  MOD_RES (1843): Hydroxyproline
  VARIANT (1844): Lys, Ser, Ala, Thr, Gly, or Val
  MOD_RES (1845): Hydroxyproline
  VARIANT (1846): Lys, Ser, Ala, Thr, Gly, or Val
  MOD_RES (1847): Hydroxyproline
  VARIANT (1848): Lys, Ser, Ala, Thr, Gly, or Val
  MOD_RES (1849): Hydroxyproline
  VARIANT (1850): Lys, Ser, Ala, Thr, Gly, or Val
  MOD_RES (1851): Hydroxyproline
  VARIANT (1852): Lys, Ser, Ala, Thr, Gly, or Val
  MOD_RES (1853): Hydroxyproline
  VARIANT (1854): Lys, Ser, Ala, Thr, Gly, or Val
  MOD_RES (1855): Hydroxyproline
  VARIANT (1856): Lys, Ser, Ala, Thr, Gly, or Val
  MOD_RES (1857): Hydroxyproline
  VARIANT (1858): Lys, Ser, Ala, Thr, Gly, or Val
  MOD_RES (1859): Hydroxyproline
  VARIANT (1860): Lys, Ser, Ala, Thr, Gly, or Val
  MOD_RES (1861): Hydroxyproline
  VARIANT (1862): Lys, Ser, Ala, Thr, Gly, or Val
  MOD_RES (1863): Hydroxyproline
  VARIANT (1864): Lys, Ser, Ala, Thr, Gly, or Val
  MOD_RES (1865): Hydroxyproline
  VARIANT (1866): Lys, Ser, Ala, Thr, Gly, or Val
  MOD_RES (1867): Hydroxyproline
  VARIANT (1868): Lys, Ser, Ala, Thr, Gly, or Val
  MOD_RES (1869): Hydroxyproline
  VARIANT (1870): Lys, Ser, Ala, Thr, Gly, or Val
  MOD_RES (1871): Hydroxyproline
  VARIANT (1872): Lys, Ser, Ala, Thr, Gly, or Val
  MOD_RES (1873): Hydroxyproline
  VARIANT (1874): Lys, Ser, Ala, Thr, Gly, or Val
  MOD_RES (1875): Hydroxyproline
  VARIANT (1876): Lys, Ser, Ala, Thr, Gly, or Val
  MOD_RES (1877): Hydroxyproline
  VARIANT (1878): Lys, Ser, Ala, Thr, Gly, or Val
  MOD_RES (1879): Hydroxyproline
  VARIANT (1880): Lys, Ser, Ala, Thr, Gly, or Val
  MOD_RES (1881): Hydroxyproline
  VARIANT (1882): Lys, Ser, Ala, Thr, Gly, or Val
  MOD_RES (1883): Hydroxyproline
  VARIANT (1884): Lys, Ser, Ala, Thr, Gly, or Val
  MOD_RES (1885): Hydroxyproline
  VARIANT (1886): Lys, Ser, Ala, Thr, Gly, or Val
  MOD_RES (1887): Hydroxyproline
  VARIANT (1888): Lys, Ser, Ala, Thr, Gly, or Val
  MOD_RES (1889): Hydroxyproline
  VARIANT (1890): Lys, Ser, Ala, Thr, Gly, or Val
  MOD_RES (1891): Hydroxyproline
  VARIANT (1892): Lys, Ser, Ala, Thr, Gly, or Val
  MOD_RES (1893): Hydroxyproline
  VARIANT (1894): Lys, Ser, Ala, Thr, Gly, or Val
  MOD_RES (1895): Hydroxyproline
  VARIANT (1896): Lys, Ser, Ala, Thr, Gly, or Val
  MOD_RES (1897): Hydroxyproline
  VARIANT (1898): Lys, Ser, Ala, Thr, Gly, or Val
  MOD_RES (1899): Hydroxyproline
  VARIANT (1900): Lys, Ser, Ala, Thr, Gly, or Val
  MOD_RES (1901): Hydroxyproline
  VARIANT (1902): Lys, Ser, Ala, Thr, Gly, or Val
  MOD_RES (1903): Hydroxyproline
  VARIANT (1904): Lys, Ser, Ala, Thr, Gly, or Val
  MOD_RES (1905): Hydroxyproline
  VARIANT (1906): Lys, Ser, Ala, Thr, Gly, or Val
  MOD_RES (1907): Hydroxyproline
  VARIANT (1908): Lys, Ser, Ala, Thr, Gly, or Val
  MOD_RES (1909): Hydroxyproline
  VARIANT (1910): Lys, Ser, Ala, Thr, Gly, or Val
  MOD_RES (1911): Hydroxyproline
  VARIANT (1912): Lys, Ser, Ala, Thr, Gly, or Val
  MOD_RES (1913): Hydroxyproline
  VARIANT (1914): Lys, Ser, Ala, Thr, Gly, or Val
  MOD_RES (1915): Hydroxyproline
  VARIANT (1916): Lys, Ser, Ala, Thr, Gly, or Val
  MOD_RES (1917): Hydroxyproline
  VARIANT (1918): Lys, Ser, Ala, Thr, Gly, or Val
  MOD_RES (1919): Hydroxyproline
  VARIANT (1920): Lys, Ser, Ala, Thr, Gly, or Val
  MOD_RES (1921): Hydroxyproline
  VARIANT (1922): Lys, Ser, Ala, Thr, Gly, or Val
  MOD_RES (1923): Hydroxyproline
  VARIANT (1924): Lys, Ser, Ala, Thr, Gly, or Val
  MOD_RES (1925): Hydroxyproline
  VARIANT (1926): Lys, Ser, Ala, Thr, Gly, or Val
  MOD_RES (1927): Hydroxyproline
  VARIANT (1928): Lys, Ser, Ala, Thr, Gly, or Val
  MOD_RES (1929): Hydroxyproline
  VARIANT (1930): Lys, Ser, Ala, Thr, Gly, or Val
  MOD_RES (1931): Hydroxyproline
  VARIANT (1932): Lys, Ser, Ala, Thr, Gly, or Val
  MOD_RES (1933): Hydroxyproline
  VARIANT (1934): Lys, Ser, Ala, Thr, Gly, or Val
  MOD_RES (1935): Hydroxyproline
  VARIANT (1936): Lys, Ser, Ala, Thr, Gly, or Val
  MOD_RES (1937): Hydroxyproline
  VARIANT (1938): Lys, Ser, Ala, Thr, Gly, or Val
  MOD_RES (1939): Hydroxyproline
  VARIANT (1940): Lys, Ser, Ala, Thr, Gly, or Val
  MOD_RES (1941): Hydroxyproline
  VARIANT (1942): Lys, Ser, Ala, Thr, Gly, or Val
  MOD_RES (1943): Hydroxyproline
  VARIANT (1944): Lys, Ser, Ala, Thr, Gly, or Val
  MOD_RES (1945): Hydroxyproline
  VARIANT (1946): Lys, Ser, Ala, Thr, Gly, or Val
  MOD_RES (1947): Hydroxyproline
  VARIANT (1948): Lys, Ser, Ala, Thr, Gly, or Val
  MOD_RES (1949): Hydroxyproline
  VARIANT (1950): Lys, Ser, Ala, Thr, Gly, or Val
  MOD_RES (1951): Hydroxyproline
  VARIANT (1952): Lys, Ser, Ala, Thr, Gly, or Val
  MOD_RES (1953): Hydroxyproline
  VARIANT (1954): Lys, Ser, Ala, Thr, Gly, or Val
  MOD_RES (1955): Hydroxyproline
  VARIANT (1956): Lys, Ser, Ala, Thr, Gly, or Val
  MOD_RES (1957): Hydroxyproline
  VARIANT (1958): Lys, Ser, Ala, Thr, Gly, or Val
  MOD_RES (1959): Hydroxyproline
  VARIANT (1960): Lys, Ser, Ala, Thr, Gly, or Val
  MOD_RES (1961): Hydroxyproline
  VARIANT (1962): Lys, Ser, Ala, Thr, Gly, or Val
  MOD_RES (1963): Hydroxyproline
  VARIANT (1964): Lys, Ser, Ala, Thr, Gly, or Val
  MOD_RES (1965): Hydroxyproline
  VARIANT (1966): Lys, Ser, Ala, Thr, Gly, or Val
  MOD_RES (1967): Hydroxyproline
  VARIANT (1968): Lys, Ser, Ala, Thr, Gly, or Val
  MOD_RES (1969): Hydroxyproline
  VARIANT (1970): Lys, Ser, Ala, Thr, Gly, or Val
  MOD_RES (1971): Hydroxyproline
  VARIANT (1972): Lys, Ser, Ala, Thr, Gly, or Val
  MOD_RES (1973): Hydroxyproline
  VARIANT (1974): Lys, Ser, Ala, Thr, Gly, or Val
  MOD_RES (1975): Hydroxyproline
  VARIANT (1976): Lys, Ser, Ala, Thr, Gly, or Val
  MOD_RES (1977): Hydroxyproline
  VARIANT (1978): Lys, Ser, Ala, Thr, Gly, or Val
  MOD_RES (1979): Hydroxyproline
  VARIANT (1980): Lys, Ser, Ala, Thr, Gly, or Val
  MOD_RES (1981): Hydroxyproline
  VARIANT (1982): Lys, Ser, Ala, Thr, Gly, or Val
  MOD_RES (1983): Hydroxyproline
  VARIANT (1984): Lys, Ser, Ala, Thr, Gly, or Val
  MOD_RES (1985): Hydroxyproline
  VARIANT (1986): Lys, Ser, Ala, Thr, Gly, or Val
  MOD_RES (1987): Hydroxyproline
  VARIANT (1988): Lys, Ser, Ala, Thr, Gly, or Val
  MOD_RES (1989): Hydroxyproline
  VARIANT (1990): Lys, Ser, Ala, Thr, Gly, or Val
  MOD_RES (1991): Hydroxyproline
  VARIANT (1992): Lys, Ser, Ala, Thr, Gly, or Val
  MOD_RES (1993): Hydroxyproline
  VARIANT (1994): Lys, Ser, Ala, Thr, Gly, or Val
  MOD_RES (1995): Hydroxyproline
  VARIANT (1996): Lys, Ser, Ala, Thr, Gly, or Val
  MOD_RES (1997): Hydroxyproline
  VARIANT (1998): Lys, Ser, Ala, Thr, Gly, or Val
  MOD_RES (1999): Hydroxyproline
  VARIANT (2000): Lys, Ser, Ala, Thr, Gly, or Val
  This sequence encompasses at least 1-1,000 (Hyp-Xaa) repeating unitsand subject to having the minumum number of Hyp-Xaa units, any one or more of Hyp-Xaa units can either be present or absent

SEQ ID NO: 158 - protein, 101 aa, Artificial Sequence
  Description of Artificial Sequence: Synthetic amino acid motif
  VARIANT (1): Lys, Ser, Ala, Thr, Gly, or Val
  This sequence encompasses at least 6 to 100 residues of Proline between positions 2 and 101, and subject to having the minumum number of Proline residues, any one or more Proline residues at positions 2 to 101 can either be present or absent
XPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPP

SEQ ID NO: 159 - protein, 101 aa, Artificial Sequence
  Description of Artificial Sequence: Synthetic amino acid motif
  VARIANT (101): Lys, Ser, Ala, Thr, Gly, or Val
  This sequence encompasses at least 6 to 100 residues of Proline between positions 1 and 100, and subject to having the minumum number of Proline residues, any one or more Proline residues at positions 1 to 100 can either be present or absent
PPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPX

SEQ ID NO: 160 - protein, 200 aa, Artificial Sequence
  Description of Artificial Sequence: Synthetic amino acid motif
  VARIANT (1)..(1): Lys, Ser, Ala, Thr, Gly, or Val
  VARIANT (3)..(3): Lys, Ser, Ala, Thr, Gly, or Val
  VARIANT (5)..(5): Lys, Ser, Ala, Thr, Gly, or Val
  VARIANT (7)..(7): Lys, Ser, Ala, Thr, Gly, or Val
  VARIANT (9)..(9): Lys, Ser, Ala, Thr, Gly, or Val
  VARIANT (11)..(11): Lys, Ser, Ala, Thr, Gly, or Val
  VARIANT (13)..(13): Lys, Ser, Ala, Thr, Gly, or Val
  VARIANT (15)..(15): Lys, Ser, Ala, Thr, Gly, or Val
  VARIANT (17)..(17): Lys, Ser, Ala, Thr, Gly, or Val
  VARIANT (19)..(19): Lys, Ser, Ala, Thr, Gly, or Val
  VARIANT (21)..(21): Lys, Ser, Ala, Thr, Gly, or Val
  VARIANT (23)..(23): Lys, Ser, Ala, Thr, Gly, or Val
  VARIANT (25)..(25): Lys, Ser, Ala, Thr, Gly, or Val
  VARIANT (27)..(27): Lys, Ser, Ala, Thr, Gly, or Val
  VARIANT (29)..(29): Lys, Ser, Ala, Thr, Gly, or Val
  VARIANT (31)..(31): Lys, Ser, Ala, Thr, Gly, or Val
  VARIANT (33)..(33): Lys, Ser, Ala, Thr, Gly, or Val
  VARIANT (35)..(35): Lys, Ser, Ala, Thr, Gly, or Val
  VARIANT (37)..(37): Lys, Ser, Ala, Thr, Gly, or Val
  VARIANT (39)..(39): Lys, Ser, Ala, Thr, Gly, or Val
  VARIANT (41)..(41): Lys, Ser, Ala, Thr, Gly, or Val
  VARIANT (43)..(43): Lys, Ser, Ala, Thr, Gly, or Val
  VARIANT (45)..(45): Lys, Ser, Ala, Thr, Gly, or Val
  VARIANT (47)..(47): Lys, Ser, Ala, Thr, Gly, or Val
  VARIANT (49)..(49): Lys, Ser, Ala, Thr, Gly, or Val
  VARIANT (51)..(51): Lys, Ser, Ala, Thr, Gly, or Val
  VARIANT (53)..(53): Lys, Ser, Ala, Thr, Gly, or Val
  VARIANT (55)..(55): Lys, Ser, Ala, Thr, Gly, or Val
  VARIANT (57)..(57): Lys, Ser, Ala, Thr, Gly, or Val
  VARIANT (59)..(59): Lys, Ser, Ala, Thr, Gly, or Val
  VARIANT (61)..(61): Lys, Ser, Ala, Thr, Gly, or Val
  VARIANT (63)..(63): Lys, Ser, Ala, Thr, Gly, or Val
  VARIANT (65)..(65): Lys, Ser, Ala, Thr, Gly, or Val
  VARIANT (67)..(67): Lys, Ser, Ala, Thr, Gly, or Val
  VARIANT (69)..(69): Lys, Ser, Ala, Thr, Gly, or Val
  VARIANT (71)..(71): Lys, Ser, Ala, Thr, Gly, or Val
  VARIANT (73)..(73): Lys, Ser, Ala, Thr, Gly, or Val
  VARIANT (75)..(75): Lys, Ser, Ala, Thr, Gly, or Val
  VARIANT (77)..(77): Lys, Ser, Ala, Thr, Gly, or Val
  VARIANT (79)..(79): Lys, Ser, Ala, Thr, Gly, or Val
  VARIANT (81)..(81): Lys, Ser, Ala, Thr, Gly, or Val
  VARIANT (83)..(83): Lys, Ser, Ala, Thr, Gly, or Val
  VARIANT (85)..(85): Lys, Ser, Ala, Thr, Gly, or Val
  VARIANT (87)..(87): Lys, Ser, Ala, Thr, Gly, or Val
  VARIANT (89)..(89): Lys, Ser, Ala, Thr, Gly, or Val
  VARIANT (91)..(91): Lys, Ser, Ala, Thr, Gly, or Val
  VARIANT (93)..(93): Lys, Ser, Ala, Thr, Gly, or Val
  VARIANT (95)..(95): Lys, Ser, Ala, Thr, Gly, or Val
  VARIANT (97)..(97): Lys, Ser, Ala, Thr, Gly, or Val
  VARIANT (99)..(99): Lys, Ser, Ala, Thr, Gly, or Val
  VARIANT (101)..(101): Lys, Ser, Ala, Thr, Gly, or Val
  VARIANT (103)..(103): Lys, Ser, Ala, Thr, Gly, or Val
  VARIANT (105)..(105): Lys, Ser, Ala, Thr, Gly, or Val
  VARIANT (107)..(107): Lys, Ser, Ala, Thr, Gly, or Val
  VARIANT (109)..(109): Lys, Ser, Ala, Thr, Gly, or Val
  VARIANT (111)..(111): Lys, Ser, Ala, Thr, Gly, or Val
  VARIANT (113)..(113): Lys, Ser, Ala, Thr, Gly, or Val
  VARIANT (115)..(115): Lys, Ser, Ala, Thr, Gly, or Val
  VARIANT (117)..(117): Lys, Ser, Ala, Thr, Gly, or Val
  VARIANT (119)..(119): Lys, Ser, Ala, Thr, Gly, or Val
  VARIANT (121)..(121): Lys, Ser, Ala, Thr, Gly, or Val
  VARIANT (123)..(123): Lys, Ser, Ala, Thr, Gly, or Val
  VARIANT (125)..(125): Lys, Ser, Ala, Thr, Gly, or Val
  VARIANT (127)..(127): Lys, Ser, Ala, Thr, Gly, or Val
  VARIANT (129)..(129): Lys, Ser, Ala, Thr, Gly, or Val
  VARIANT (131)..(131): Lys, Ser, Ala, Thr, Gly, or Val
  VARIANT (133)..(133): Lys, Ser, Ala, Thr, Gly, or Val
  VARIANT (135)..(135): Lys, Ser, Ala, Thr, Gly, or Val
  VARIANT (137)..(137): Lys, Ser, Ala, Thr, Gly, or Val
  VARIANT (139)..(139): Lys, Ser, Ala, Thr, Gly, or Val
  VARIANT (141)..(141): Lys, Ser, Ala, Thr, Gly, or Val
  VARIANT (143)..(143): Lys, Ser, Ala, Thr, Gly, or Val
  VARIANT (145)..(145): Lys, Ser, Ala, Thr, Gly, or Val
  VARIANT (147)..(147): Lys, Ser, Ala, Thr, Gly, or Val
  VARIANT (149)..(149): Lys, Ser, Ala, Thr, Gly, or Val
  VARIANT (151)..(151): Lys, Ser, Ala, Thr, Gly, or Val
  VARIANT (153)..(153): Lys, Ser, Ala, Thr, Gly, or Val
  VARIANT (155)..(155): Lys, Ser, Ala, Thr, Gly, or Val
  VARIANT (157)..(157): Lys, Ser, Ala, Thr, Gly, or Val
  VARIANT (159)..(159): Lys, Ser, Ala, Thr, Gly, or Val
  VARIANT (161)..(161): Lys, Ser, Ala, Thr, Gly, or Val
  VARIANT (163)..(163): Lys, Ser, Ala, Thr, Gly, or Val
  VARIANT (165)..(165): Lys, Ser, Ala, Thr, Gly, or Val
  VARIANT (167)..(167): Lys, Ser, Ala, Thr, Gly, or Val
  VARIANT (169)..(169): Lys, Ser, Ala, Thr, Gly, or Val
  VARIANT (171)..(171): Lys, Ser, Ala, Thr, Gly, or Val
  VARIANT (173)..(173): Lys, Ser, Ala, Thr, Gly, or Val
  VARIANT (175)..(175): Lys, Ser, Ala, Thr, Gly, or Val
  VARIANT (177)..(177): Lys, Ser, Ala, Thr, Gly, or Val
  VARIANT (179)..(179): Lys, Ser, Ala, Thr, Gly, or Val
  VARIANT (181)..(181): Lys, Ser, Ala, Thr, Gly, or Val
  VARIANT (183)..(183): Lys, Ser, Ala, Thr, Gly, or Val
  VARIANT (185)..(185): Lys, Ser, Ala, Thr, Gly, or Val
  VARIANT (187)..(187): Lys, Ser, Ala, Thr, Gly, or Val
  VARIANT (189)..(189): Lys, Ser, Ala, Thr, Gly, or Val
  VARIANT (191)..(191): Lys, Ser, Ala, Thr, Gly, or Val
  VARIANT (193)..(193): Lys, Ser, Ala, Thr, Gly, or Val
  VARIANT (195)..(195): Lys, Ser, Ala, Thr, Gly, or Val
  VARIANT (197)..(197): Lys, Ser, Ala, Thr, Gly, or Val
  VARIANT (199)..(199): Lys, Ser, Ala, Thr, Gly, or Val
  This sequence encompasses at least 6-100 (Xaa-Pro) repeating units
XPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXP

SEQ ID NO: 161 - protein, 200 aa, Artificial Sequence
  Description of Artificial Sequence: Synthetic amino acid motif
  VARIANT (2)..(2): Lys, Ser, Ala, Thr, Gly, or Val
  VARIANT (4)..(4): Lys, Ser, Ala, Thr, Gly, or Val
  VARIANT (6)..(6): Lys, Ser, Ala, Thr, Gly, or Val
  VARIANT (8)..(8): Lys, Ser, Ala, Thr, Gly, or Val
  VARIANT (10)..(10): Lys, Ser, Ala, Thr, Gly, or Val
  VARIANT (12)..(12): Lys, Ser, Ala, Thr, Gly, or Val
  VARIANT (14)..(14): Lys, Ser, Ala, Thr, Gly, or Val
  VARIANT (16)..(16): Lys, Ser, Ala, Thr, Gly, or Val
  VARIANT (18)..(18): Lys, Ser, Ala, Thr, Gly, or Val
  VARIANT (20)..(20): Lys, Ser, Ala, Thr, Gly, or Val
  VARIANT (22)..(22): Lys, Ser, Ala, Thr, Gly, or Val
  VARIANT (24)..(24): Lys, Ser, Ala, Thr, Gly, or Val
  VARIANT (26)..(26): Lys, Ser, Ala, Thr, Gly, or Val
  VARIANT (28)..(28): Lys, Ser, Ala, Thr, Gly, or Val
  VARIANT (30)..(30): Lys, Ser, Ala, Thr, Gly, or Val
  VARIANT (32)..(32): Lys, Ser, Ala, Thr, Gly, or Val
  VARIANT (34)..(34): Lys, Ser, Ala, Thr, Gly, or Val
  VARIANT (36)..(36): Lys, Ser, Ala, Thr, Gly, or Val
  VARIANT (38)..(38): Lys, Ser, Ala, Thr, Gly, or Val
  VARIANT (40)..(40): Lys, Ser, Ala, Thr, Gly, or Val
  VARIANT (42)..(42): Lys, Ser, Ala, Thr, Gly, or Val
  VARIANT (44)..(44): Lys, Ser, Ala, Thr, Gly, or Val
  VARIANT (46)..(46): Lys, Ser, Ala, Thr, Gly, or Val
  VARIANT (48)..(48): Lys, Ser, Ala, Thr, Gly, or Val
  VARIANT (50)..(50): Lys, Ser, Ala, Thr, Gly, or Val
  VARIANT (52)..(52): Lys, Ser, Ala, Thr, Gly, or Val
  VARIANT (54)..(54): Lys, Ser, Ala, Thr, Gly, or Val
  VARIANT (56)..(56): Lys, Ser, Ala, Thr, Gly, or Val
  VARIANT (58)..(58): Lys, Ser, Ala, Thr, Gly, or Val
  VARIANT (60)..(60): Lys, Ser, Ala, Thr, Gly, or Val
  VARIANT (62)..(62): Lys, Ser, Ala, Thr, Gly, or Val
  VARIANT (64)..(64): Lys, Ser, Ala, Thr, Gly, or Val
  VARIANT (66)..(66): Lys, Ser, Ala, Thr, Gly, or Val
  VARIANT (68)..(68): Lys, Ser, Ala, Thr, Gly, or Val
  VARIANT (70)..(70): Lys, Ser, Ala, Thr, Gly, or Val
  VARIANT (72)..(72): Lys, Ser, Ala, Thr, Gly, or Val
  VARIANT (74)..(74): Lys, Ser, Ala, Thr, Gly, or Val
  VARIANT (76)..(76): Lys, Ser, Ala, Thr, Gly, or Val
  VARIANT (78)..(78): Lys, Ser, Ala, Thr, Gly, or Val
  VARIANT (80)..(80): Lys, Ser, Ala, Thr, Gly, or Val
  VARIANT (82)..(82): Lys, Ser, Ala, Thr, Gly, or Val
  VARIANT (84)..(84): Lys, Ser, Ala, Thr, Gly, or Val
  VARIANT (86)..(86): Lys, Ser, Ala, Thr, Gly, or Val
  VARIANT (88)..(88): Lys, Ser, Ala, Thr, Gly, or Val
  VARIANT (90)..(90): Lys, Ser, Ala, Thr, Gly, or Val
  VARIANT (92)..(92): Lys, Ser, Ala, Thr, Gly, or Val
  VARIANT (94)..(94): Lys, Ser, Ala, Thr, Gly, or Val
  VARIANT (96)..(96): Lys, Ser, Ala, Thr, Gly, or Val
  VARIANT (98)..(98): Lys, Ser, Ala, Thr, Gly, or Val
  VARIANT (100)..(100): Lys, Ser, Ala, Thr, Gly, or Val
  VARIANT (102)..(102): Lys, Ser, Ala, Thr, Gly, or Val
  VARIANT (104)..(104): Lys, Ser, Ala, Thr, Gly, or Val
  VARIANT (106)..(106): Lys, Ser, Ala, Thr, Gly, or Val
  VARIANT (108)..(108): Lys, Ser, Ala, Thr, Gly, or Val
  VARIANT (110)..(110): Lys, Ser, Ala, Thr, Gly, or Val
  VARIANT (112)..(112): Lys, Ser, Ala, Thr, Gly, or Val
  VARIANT (114)..(114): Lys, Ser, Ala, Thr, Gly, or Val
  VARIANT (116)..(116): Lys, Ser, Ala, Thr, Gly, or Val
  VARIANT (118)..(118): Lys, Ser, Ala, Thr, Gly, or Val
  VARIANT (120)..(120): Lys, Ser, Ala, Thr, Gly, or Val
  VARIANT (122)..(122): Lys, Ser, Ala, Thr, Gly, or Val
  VARIANT (124)..(124): Lys, Ser, Ala, Thr, Gly, or Val
  VARIANT (126)..(126): Lys, Ser, Ala, Thr, Gly, or Val
  VARIANT (128)..(128): Lys, Ser, Ala, Thr, Gly, or Val
  VARIANT (130)..(130): Lys, Ser, Ala, Thr, Gly, or Val
  VARIANT (132)..(132): Lys, Ser, Ala, Thr, Gly, or Val
  VARIANT (134)..(134): Lys, Ser, Ala, Thr, Gly, or Val
  VARIANT (136)..(136): Lys, Ser, Ala, Thr, Gly, or Val
  VARIANT (138)..(138): Lys, Ser, Ala, Thr, Gly, or Val
  VARIANT (140)..(140): Lys, Ser, Ala, Thr, Gly, or Val
  VARIANT (142)..(142): Lys, Ser, Ala, Thr, Gly, or Val
  VARIANT (144)..(144): Lys, Ser, Ala, Thr, Gly, or Val
  VARIANT (146)..(146): Lys, Ser, Ala, Thr, Gly, or Val
  VARIANT (148)..(148): Lys, Ser, Ala, Thr, Gly, or Val
  VARIANT (150)..(150): Lys, Ser, Ala, Thr, Gly, or Val
  VARIANT (152)..(152): Lys, Ser, Ala, Thr, Gly, or Val
  VARIANT (154)..(154): Lys, Ser, Ala, Thr, Gly, or Val
  VARIANT (156)..(156): Lys, Ser, Ala, Thr, Gly, or Val
  VARIANT (158)..(158): Lys, Ser, Ala, Thr, Gly, or Val
  VARIANT (160)..(160): Lys, Ser, Ala, Thr, Gly, or Val
  VARIANT (162)..(162): Lys, Ser, Ala, Thr, Gly, or Val
  VARIANT (164)..(164): Lys, Ser, Ala, Thr, Gly, or Val
  VARIANT (166)..(166): Lys, Ser, Ala, Thr, Gly, or Val
  VARIANT (168)..(168): Lys, Ser, Ala, Thr, Gly, or Val
  VARIANT (170)..(170): Lys, Ser, Ala, Thr, Gly, or Val
  VARIANT (172)..(172): Lys, Ser, Ala, Thr, Gly, or Val
  VARIANT (174)..(174): Lys, Ser, Ala, Thr, Gly, or Val
  VARIANT (176)..(176): Lys, Ser, Ala, Thr, Gly, or Val
  VARIANT (178)..(178): Lys, Ser, Ala, Thr, Gly, or Val
  VARIANT (180)..(180): Lys, Ser, Ala, Thr, Gly, or Val
  VARIANT (182)..(182): Lys, Ser, Ala, Thr, Gly, or Val
  VARIANT (184)..(184): Lys, Ser, Ala, Thr, Gly, or Val
  VARIANT (186)..(186): Lys, Ser, Ala, Thr, Gly, or Val
  VARIANT (188)..(188): Lys, Ser, Ala, Thr, Gly, or Val
  VARIANT (190)..(190): Lys, Ser, Ala, Thr, Gly, or Val
  VARIANT (192)..(192): Lys, Ser, Ala, Thr, Gly, or Val
  VARIANT (194)..(194): Lys, Ser, Ala, Thr, Gly, or Val
  VARIANT (196)..(196): Lys, Ser, Ala, Thr, Gly, or Val
  VARIANT (198)..(198): Lys, Ser, Ala, Thr, Gly, or Val
  VARIANT (200)..(200): Lys, Ser, Ala, Thr, Gly, or Val
  This sequence encompasses at least 6-100 (Pro-Xaa) repeating units
PXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPXPX

SEQ ID NO: 162 - protein, 102 aa, Artificial Sequence; identical to SEQ ID NO: 7
  Description of Artificial Sequence: Synthetic amino acid motif
  VARIANT (1): Lys, Ser, Ala, Thr, Gly, or Val
  MOD_RES (3)..(102): This region encompasses at least 6 to 100 residues of Hydroxyproline, and subject to having the minumum number of residues, any one or more of amino acid residues 3 to 102 can either be present or absent

SEQ ID NO: 163 - protein, 101 aa, Artificial Sequence; identical to SEQ ID NO: 8
  Description of Artificial Sequence: Synthetic amino acid motif
  VARIANT (1): Lys, Ser, Ala, Thr, Gly, or Val
  MOD_RES (2)..(101): This region encompasses at least 6 to 100 residues of Hydroxyproline, and subject to having the minumum number of residues, any one or more of amino acid residues 2 to 101 can either be present or absent

SEQ ID NO: 164 - protein, 101 aa, Artificial Sequence; identical to SEQ ID NO: 8
  Description of Artificial Sequence: Synthetic amino acid motif
  MOD_RES (1)..(100): This region encompasses at least 6 to 100 residues of Hydroxyproline, and subject to having the minumum number of residues, any one or more of amino acid residues 1 to 100 can either be present or absent
  VARIANT (101): Lys, Ser, Ala, Thr, Gly, or Val

SEQ ID NO: 165 - protein, 200 aa, Artificial Sequence; identical to SEQ ID NO: 9
  Description of Artificial Sequence: Synthetic amino acid motif
  VARIANT (1): Lys, Ser, Ala, Thr, Gly, or Val
  MOD_RES (2): Hydroxyproline
  VARIANT (3): Lys, Ser, Ala, Thr, Gly, or Val
  MOD_RES (4): Hydroxyproline
  VARIANT (5): Lys, Ser, Ala, Thr, Gly, or Val
  MOD_RES (6): Hydroxyproline
  VARIANT (7): Lys, Ser, Ala, Thr, Gly, or Val
  MOD_RES (8): Hydroxyproline
  VARIANT (9): Lys, Ser, Ala, Thr, Gly, or Val
  MOD_RES (10): Hydroxyproline
  VARIANT (11): Lys, Ser, Ala, Thr, Gly, or Val
  MOD_RES (12): Hydroxyproline
  VARIANT (13): Lys, Ser, Ala, Thr, Gly, or Val
  MOD_RES (14): Hydroxyproline
  VARIANT (15): Lys, Ser, Ala, Thr, Gly, or Val
  MOD_RES (16): Hydroxyproline
  VARIANT (17): Lys, Ser, Ala, Thr, Gly, or Val
  MOD_RES (18): Hydroxyproline
  VARIANT (19): Lys, Ser, Ala, Thr, Gly, or Val
  MOD_RES (20): Hydroxyproline
  VARIANT (21): Lys, Ser, Ala, Thr, Gly, or Val
  MOD_RES (22): Hydroxyproline
  VARIANT (23): Lys, Ser, Ala, Thr, Gly, or Val
  MOD_RES (24): Hydroxyproline
  VARIANT (25): Lys, Ser, Ala, Thr, Gly, or Val
  MOD_RES (26): Hydroxyproline
  VARIANT (27): Lys, Ser, Ala, Thr, Gly, or Val
  MOD_RES (28): Hydroxyproline
  VARIANT (29): Lys, Ser, Ala, Thr, Gly, or Val
  MOD_RES (30): Hydroxyproline
  VARIANT (31): Lys, Ser, Ala, Thr, Gly, or Val
  MOD_RES (32): Hydroxyproline
  VARIANT (33): Lys, Ser, Ala, Thr, Gly, or Val
  MOD_RES (34): Hydroxyproline
  VARIANT (35): Lys, Ser, Ala, Thr, Gly, or Val
  MOD_RES (36): Hydroxyproline
  VARIANT (37): Lys, Ser, Ala, Thr, Gly, or Val
  MOD_RES (38): Hydroxyproline
  VARIANT (39): Lys, Ser, Ala, Thr, Gly, or Val
  MOD_RES (40): Hydroxyproline
  VARIANT (41): Lys, Ser, Ala, Thr, Gly, or Val
  MOD_RES (42): Hydroxyproline
  VARIANT (43): Lys, Ser, Ala, Thr, Gly, or Val
  MOD_RES (44): Hydroxyproline
  VARIANT (45): Lys, Ser, Ala, Thr, Gly, or Val
  MOD_RES (46): Hydroxyproline
  VARIANT (47): Lys, Ser, Ala, Thr, Gly, or Val
  MOD_RES (48): Hydroxyproline
  VARIANT (49): Lys, Ser, Ala, Thr, Gly, or Val
  MOD_RES (50): Hydroxyproline
  VARIANT (51): Lys, Ser, Ala, Thr, Gly, or Val
  MOD_RES (52): Hydroxyproline
  VARIANT (53): Lys, Ser, Ala, Thr, Gly, or Val
  MOD_RES (54): Hydroxyproline
  VARIANT (55): Lys, Ser, Ala, Thr, Gly, or Val
  MOD_RES (56): Hydroxyproline
  VARIANT (57): Lys, Ser, Ala, Thr, Gly, or Val
  MOD_RES (58): Hydroxyproline
  VARIANT (59): Lys, Ser, Ala, Thr, Gly, or Val
  MOD_RES (60): Hydroxyproline
  VARIANT (61): Lys, Ser, Ala, Thr, Gly, or Val
  MOD_RES (62): Hydroxyproline
  VARIANT (63): Lys, Ser, Ala, Thr, Gly, or Val
  MOD_RES (64): Hydroxyproline
  VARIANT (65): Lys, Ser, Ala, Thr, Gly, or Val
  MOD_RES (66): Hydroxyproline
  VARIANT (67): Lys, Ser, Ala, Thr, Gly, or Val
  MOD_RES (68): Hydroxyproline
  VARIANT (69): Lys, Ser, Ala, Thr, Gly, or Val
  MOD_RES (70): Hydroxyproline
  VARIANT (71): Lys, Ser, Ala, Thr, Gly, or Val
  MOD_RES (72): Hydroxyproline
  VARIANT (73): Lys, Ser, Ala, Thr, Gly, or Val
  MOD_RES (74): Hydroxyproline
  VARIANT (75): Lys, Ser, Ala, Thr, Gly, or Val
  MOD_RES (76): Hydroxyproline
  VARIANT (77): Lys, Ser, Ala, Thr, Gly, or Val
  MOD_RES (78): Hydroxyproline
  VARIANT (79): Lys, Ser, Ala, Thr, Gly, or Val
  MOD_RES (80): Hydroxyproline
  VARIANT (81): Lys, Ser, Ala, Thr, Gly, or Val
  MOD_RES (82): Hydroxyproline
  VARIANT (83): Lys, Ser, Ala, Thr, Gly, or Val
  MOD_RES (84): Hydroxyproline
  VARIANT (85): Lys, Ser, Ala, Thr, Gly, or Val
  MOD_RES (86): Hydroxyproline
  VARIANT (87): Lys, Ser, Ala, Thr, Gly, or Val
  MOD_RES (88): Hydroxyproline
  VARIANT (89): Lys, Ser, Ala, Thr, Gly, or Val
  MOD_RES (90): Hydroxyproline
  VARIANT (91): Lys, Ser, Ala, Thr, Gly, or Val
  MOD_RES (92): Hydroxyproline
  VARIANT (93): Lys, Ser, Ala, Thr, Gly, or Val
  MOD_RES (94): Hydroxyproline
  VARIANT (95): Lys, Ser, Ala, Thr, Gly, or Val
  MOD_RES (96): Hydroxyproline
  VARIANT (97): Lys, Ser, Ala, Thr, Gly, or Val
  MOD_RES (98): Hydroxyproline
  VARIANT (99): Lys, Ser, Ala, Thr, Gly, or Val
  MOD_RES (100): Hydroxyproline
  VARIANT (101): Lys, Ser, Ala, Thr, Gly, or Val
  MOD_RES (102): Hydroxyproline
  VARIANT (103): Lys, Ser, Ala, Thr, Gly, or Val
  MOD_RES (104): Hydroxyproline
  VARIANT (105): Lys, Ser, Ala, Thr, Gly, or Val
  MOD_RES (106): Hydroxyproline
  VARIANT (107): Lys, Ser, Ala, Thr, Gly, or Val
  MOD_RES (108): Hydroxyproline
  VARIANT (109): Lys, Ser, Ala, Thr, Gly, or Val
  MOD_RES (110): Hydroxyproline
  VARIANT (111): Lys, Ser, Ala, Thr, Gly, or Val
  MOD_RES (112): Hydroxyproline
  VARIANT (113): Lys, Ser, Ala, Thr, Gly, or Val
  MOD_RES (114): Hydroxyproline
  VARIANT (115): Lys, Ser, Ala, Thr, Gly, or Val
  MOD_RES (116): Hydroxyproline
  VARIANT (117): Lys, Ser, Ala, Thr, Gly, or Val
  MOD_RES (118): Hydroxyproline
  VARIANT (119): Lys, Ser, Ala, Thr, Gly, or Val
  MOD_RES (120): Hydroxyproline
  VARIANT (121): Lys, Ser, Ala, Thr, Gly, or Val
  MOD_RES (122): Hydroxyproline
  VARIANT (123): Lys, Ser, Ala, Thr, Gly, or Val
  MOD_RES (124): Hydroxyproline
  VARIANT (125): Lys, Ser, Ala, Thr, Gly, or Val
  MOD_RES (126): Hydroxyproline
  VARIANT (127): Lys, Ser, Ala, Thr, Gly, or Val
  MOD_RES (128): Hydroxyproline
  VARIANT (129): Lys, Ser, Ala, Thr, Gly, or Val
  MOD_RES (130): Hydroxyproline
  VARIANT (131): Lys, Ser, Ala, Thr, Gly, or Val
  MOD_RES (132): Hydroxyproline
  VARIANT (133): Lys, Ser, Ala, Thr, Gly, or Val
  MOD_RES (134): Hydroxyproline
  VARIANT (135): Lys, Ser, Ala, Thr, Gly, or Val
  MOD_RES (136): Hydroxyproline
  VARIANT (137): Lys, Ser, Ala, Thr, Gly, or Val
  MOD_RES (138): Hydroxyproline
  VARIANT (139): Lys, Ser, Ala, Thr, Gly, or Val
  MOD_RES (140): Hydroxyproline
  VARIANT (141): Lys, Ser, Ala, Thr, Gly, or Val
  MOD_RES (142): Hydroxyproline
  VARIANT (143): Lys, Ser, Ala, Thr, Gly, or Val
  MOD_RES (144): Hydroxyproline
  VARIANT (145): Lys, Ser, Ala, Thr, Gly, or Val
  MOD_RES (146): Hydroxyproline
  VARIANT (147): Lys, Ser, Ala, Thr, Gly, or Val
  MOD_RES (148): Hydroxyproline
  VARIANT (149): Lys, Ser, Ala, Thr, Gly, or Val
  MOD_RES (150): Hydroxyproline
  VARIANT (151): Lys, Ser, Ala, Thr, Gly, or Val
  MOD_RES (152): Hydroxyproline
  VARIANT (153): Lys, Ser, Ala, Thr, Gly, or Val
  MOD_RES (154): Hydroxyproline
  VARIANT (155): Lys, Ser, Ala, Thr, Gly, or Val
  MOD_RES (156): Hydroxyproline
  VARIANT (157): Lys, Ser, Ala, Thr, Gly, or Val
  MOD_RES (158): Hydroxyproline
  VARIANT (159): Lys, Ser, Ala, Thr, Gly, or Val
  MOD_RES (160): Hydroxyproline
  VARIANT (161): Lys, Ser, Ala, Thr, Gly, or Val
  MOD_RES (162): Hydroxyproline
  VARIANT (163): Lys, Ser, Ala, Thr, Gly, or Val
  MOD_RES (164): Hydroxyproline
  VARIANT (165): Lys, Ser, Ala, Thr, Gly, or Val
  MOD_RES (166): Hydroxyproline
  VARIANT (167): Lys, Ser, Ala, Thr, Gly, or Val
  MOD_RES (168): Hydroxyproline
  VARIANT (169): Lys, Ser, Ala, Thr, Gly, or Val
  MOD_RES (170): Hydroxyproline
  VARIANT (171): Lys, Ser, Ala, Thr, Gly, or Val
  MOD_RES (172): Hydroxyproline
  VARIANT (173): Lys, Ser, Ala, Thr, Gly, or Val
  MOD_RES (174): Hydroxyproline
  VARIANT (175): Lys, Ser, Ala, Thr, Gly, or Val
  MOD_RES (176): Hydroxyproline
  VARIANT (177): Lys, Ser, Ala, Thr, Gly, or Val
  MOD_RES (178): Hydroxyproline
  VARIANT (179): Lys, Ser, Ala, Thr, Gly, or Val
  MOD_RES (180): Hydroxyproline
  VARIANT (181): Lys, Ser, Ala, Thr, Gly, or Val
  MOD_RES (182): Hydroxyproline
  VARIANT (183): Lys, Ser, Ala, Thr, Gly, or Val
  MOD_RES (184): Hydroxyproline
  VARIANT (185): Lys, Ser, Ala, Thr, Gly, or Val
  MOD_RES (186): Hydroxyproline
  VARIANT (187): Lys, Ser, Ala, Thr, Gly, or Val
  MOD_RES (188): Hydroxyproline
  VARIANT (189): Lys, Ser, Ala, Thr, Gly, or Val
  MOD_RES (190): Hydroxyproline
  VARIANT (191): Lys, Ser, Ala, Thr, Gly, or Val
  MOD_RES (192): Hydroxyproline
  VARIANT (193): Lys, Ser, Ala, Thr, Gly, or Val
  MOD_RES (194): Hydroxyproline
  VARIANT (195): Lys, Ser, Ala, Thr, Gly, or Val
  MOD_RES (196): Hydroxyproline
  VARIANT (197): Lys, Ser, Ala, Thr, Gly, or Val
  MOD_RES (198): Hydroxyproline
  VARIANT (199): Lys, Ser, Ala, Thr, Gly, or Val
  MOD_RES (200): Hydroxyproline
  This sequence encompasses at least 6-100 (Xaa-Hyp) repeating units

SEQ ID NO: 166 - protein, 200 aa, Artificial Sequence; identical to SEQ ID NO: 9
  Description of Artificial Sequence: Synthetic amino acid motif
  MOD_RES (1): Hydroxyproline
  VARIANT (2): Lys, Ser, Ala, Thr, Gly, or Val
  MOD_RES (3): Hydroxyproline
  VARIANT (4): Lys, Ser, Ala, Thr, Gly, or Val
  MOD_RES (5): Hydroxyproline
  VARIANT (6): Lys, Ser, Ala, Thr, Gly, or Val
  MOD_RES (7): Hydroxyproline
  VARIANT (8): Lys, Ser, Ala, Thr, Gly, or Val
  MOD_RES (9): Hydroxyproline
  VARIANT (10): Lys, Ser, Ala, Thr, Gly, or Val
  MOD_RES (11): Hydroxyproline
  VARIANT (12): Lys, Ser, Ala, Thr, Gly, or Val
  MOD_RES (13): Hydroxyproline
  VARIANT (14): Lys, Ser, Ala, Thr, Gly, or Val
  MOD_RES (15): Hydroxyproline
  VARIANT (16): Lys, Ser, Ala, Thr, Gly, or Val
  MOD_RES (17): Hydroxyproline
  VARIANT (18): Lys, Ser, Ala, Thr, Gly, or Val
  MOD_RES (19): Hydroxyproline
  VARIANT (20): Lys, Ser, Ala, Thr, Gly, or Val
  MOD_RES (21): Hydroxyproline
  VARIANT (22): Lys, Ser, Ala, Thr, Gly, or Val
  MOD_RES (23): Hydroxyproline
  VARIANT (24): Lys, Ser, Ala, Thr, Gly, or Val
  MOD_RES (25): Hydroxyproline
  VARIANT (26): Lys, Ser, Ala, Thr, Gly, or Val
  MOD_RES (27): Hydroxyproline
  VARIANT (28): Lys, Ser, Ala, Thr, Gly, or Val
  MOD_RES (29): Hydroxyproline
  VARIANT (30): Lys, Ser, Ala, Thr, Gly, or Val
  MOD_RES (31): Hydroxyproline
  VARIANT (32): Lys, Ser, Ala, Thr, Gly, or Val
  MOD_RES (33): Hydroxyproline
  VARIANT (34): Lys, Ser, Ala, Thr, Gly, or Val
  MOD_RES (35): Hydroxyproline
  VARIANT (36): Lys, Ser, Ala, Thr, Gly, or Val
  MOD_RES (37): Hydroxyproline
  VARIANT (38): Lys, Ser, Ala, Thr, Gly, or Val
  MOD_RES (39): Hydroxyproline
  VARIANT (40): Lys, Ser, Ala, Thr, Gly, or Val
  MOD_RES (41): Hydroxyproline
  VARIANT (42): Lys, Ser, Ala, Thr, Gly, or Val
  MOD_RES (43): Hydroxyproline
  VARIANT (44): Lys, Ser, Ala, Thr, Gly, or Val
  MOD_RES (45): Hydroxyproline
  VARIANT (46): Lys, Ser, Ala, Thr, Gly, or Val
  MOD_RES (47): Hydroxyproline
  VARIANT (48): Lys, Ser, Ala, Thr, Gly, or Val
  MOD_RES (49): Hydroxyproline
  VARIANT (50): Lys, Ser, Ala, Thr, Gly, or Val
  MOD_RES (51): Hydroxyproline
  VARIANT (52): Lys, Ser, Ala, Thr, Gly, or Val
  MOD_RES (53): Hydroxyproline
  VARIANT (54): Lys, Ser, Ala, Thr, Gly, or Val
  MOD_RES (55): Hydroxyproline
  VARIANT (56): Lys, Ser, Ala, Thr, Gly, or Val
  MOD_RES (57): Hydroxyproline
  VARIANT (58): Lys, Ser, Ala, Thr, Gly, or Val
  MOD_RES (59): Hydroxyproline
  VARIANT (60): Lys, Ser, Ala, Thr, Gly, or Val
  MOD_RES (61): Hydroxyproline
  VARIANT (62): Lys, Ser, Ala, Thr, Gly, or Val
  MOD_RES (63): Hydroxyproline
  VARIANT (64): Lys, Ser, Ala, Thr, Gly, or Val
  MOD_RES (65): Hydroxyproline
  VARIANT (66): Lys, Ser, Ala, Thr, Gly, or Val
  MOD_RES (67): Hydroxyproline
  VARIANT (68): Lys, Ser, Ala, Thr, Gly, or Val
  MOD_RES (69): Hydroxyproline
  VARIANT (70): Lys, Ser, Ala, Thr, Gly, or Val
  MOD_RES (71): Hydroxyproline
  VARIANT (72): Lys, Ser, Ala, Thr, Gly, or Val
  MOD_RES (73): Hydroxyproline
  VARIANT (74): Lys, Ser, Ala, Thr, Gly, or Val
  MOD_RES (75): Hydroxyproline
  VARIANT (76): Lys, Ser, Ala, Thr, Gly, or Val
  MOD_RES (77): Hydroxyproline
  VARIANT (78): Lys, Ser, Ala, Thr, Gly, or Val
  MOD_RES (79): Hydroxyproline
  VARIANT (80): Lys, Ser, Ala, Thr, Gly, or Val
  MOD_RES (81): Hydroxyproline
  VARIANT (82): Lys, Ser, Ala, Thr, Gly, or Val
  MOD_RES (83): Hydroxyproline
  VARIANT (84): Lys, Ser, Ala, Thr, Gly, or Val
  MOD_RES (85): Hydroxyproline
  VARIANT (86): Lys, Ser, Ala, Thr, Gly, or Val
  MOD_RES (87): Hydroxyproline
  VARIANT (88): Lys, Ser, Ala, Thr, Gly, or Val
  MOD_RES (89): Hydroxyproline
  VARIANT (90): Lys, Ser, Ala, Thr, Gly, or Val
  MOD_RES (91): Hydroxyproline
  VARIANT (92): Lys, Ser, Ala, Thr, Gly, or Val
  MOD_RES (93): Hydroxyproline
  VARIANT (94): Lys, Ser, Ala, Thr, Gly, or Val
  MOD_RES (95): Hydroxyproline
  VARIANT (96): Lys, Ser, Ala, Thr, Gly, or Val
  MOD_RES (97): Hydroxyproline
  VARIANT (98): Lys, Ser, Ala, Thr, Gly, or Val
  MOD_RES (99): Hydroxyproline
  VARIANT (100): Lys, Ser, Ala, Thr, Gly, or Val
  MOD_RES (101): Hydroxyproline
  VARIANT (102): Lys, Ser, Ala, Thr, Gly, or Val
  MOD_RES (103): Hydroxyproline
  VARIANT (104): Lys, Ser, Ala, Thr, Gly, or Val
  MOD_RES (105): Hydroxyproline
  VARIANT (106): Lys, Ser, Ala, Thr, Gly, or Val
  MOD_RES (107): Hydroxyproline
  VARIANT (108): Lys, Ser, Ala, Thr, Gly, or Val
  MOD_RES (109): Hydroxyproline
  VARIANT (110): Lys, Ser, Ala, Thr, Gly, or Val
  MOD_RES (111): Hydroxyproline
  VARIANT (112): Lys, Ser, Ala, Thr, Gly, or Val
  MOD_RES (113): Hydroxyproline
  VARIANT (114): Lys, Ser, Ala, Thr, Gly, or Val
  MOD_RES (115): Hydroxyproline
  VARIANT (116): Lys, Ser, Ala, Thr, Gly, or Val
  MOD_RES (117): Hydroxyproline
  VARIANT (118): Lys, Ser, Ala, Thr, Gly, or Val
  MOD_RES (119): Hydroxyproline
  VARIANT (120): Lys, Ser, Ala, Thr, Gly, or Val
  MOD_RES (121): Hydroxyproline
  VARIANT (122): Lys, Ser, Ala, Thr, Gly, or Val
  MOD_RES (123): Hydroxyproline
  VARIANT (124): Lys, Ser, Ala, Thr, Gly, or Val
  MOD_RES (125): Hydroxyproline
  VARIANT (126): Lys, Ser, Ala, Thr, Gly, or Val
  MOD_RES (127): Hydroxyproline
  VARIANT (128): Lys, Ser, Ala, Thr, Gly, or Val
  MOD_RES (129): Hydroxyproline
  VARIANT (130): Lys, Ser, Ala, Thr, Gly, or Val
  MOD_RES (131): Hydroxyproline
  VARIANT (132): Lys, Ser, Ala, Thr, Gly, or Val
  MOD_RES (133): Hydroxyproline
  VARIANT (134): Lys, Ser, Ala, Thr, Gly, or Val
  MOD_RES (135): Hydroxyproline
  VARIANT (136): Lys, Ser, Ala, Thr, Gly, or Val
  MOD_RES (137): Hydroxyproline
  VARIANT (138): Lys, Ser, Ala, Thr, Gly, or Val
  MOD_RES (139): Hydroxyproline
  VARIANT (140): Lys, Ser, Ala, Thr, Gly, or Val
  MOD_RES (141): Hydroxyproline
  VARIANT (142): Lys, Ser, Ala, Thr, Gly, or Val
  MOD_RES (143): Hydroxyproline
  VARIANT (144): Lys, Ser, Ala, Thr, Gly, or Val
  MOD_RES (145): Hydroxyproline
  VARIANT (146): Lys, Ser, Ala, Thr, Gly, or Val
  MOD_RES (147): Hydroxyproline
  VARIANT (148): Lys, Ser, Ala, Thr, Gly, or Val
  MOD_RES (149): Hydroxyproline
  VARIANT (150): Lys, Ser, Ala, Thr, Gly, or Val
  MOD_RES (151): Hydroxyproline
  VARIANT (152): Lys, Ser, Ala, Thr, Gly, or Val
  MOD_RES (153): Hydroxyproline
  VARIANT (154): Lys, Ser, Ala, Thr, Gly, or Val
  MOD_RES (155): Hydroxyproline
  VARIANT (156): Lys, Ser, Ala, Thr, Gly, or Val
  MOD_RES (157): Hydroxyproline
  VARIANT (158): Lys, Ser, Ala, Thr, Gly, or Val
  MOD_RES (159): Hydroxyproline
  VARIANT (160): Lys, Ser, Ala, Thr, Gly, or Val
  MOD_RES (161): Hydroxyproline
  VARIANT (162): Lys, Ser, Ala, Thr, Gly, or Val
  MOD_RES (163): Hydroxyproline
  VARIANT (164): Lys, Ser, Ala, Thr, Gly, or Val
  MOD_RES (165): Hydroxyproline
  VARIANT (166): Lys, Ser, Ala, Thr, Gly, or Val
  MOD_RES (167): Hydroxyproline
  VARIANT (168): Lys, Ser, Ala, Thr, Gly, or Val
  MOD_RES (169): Hydroxyproline
  VARIANT (170): Lys, Ser, Ala, Thr, Gly, or Val
  MOD_RES (171): Hydroxyproline
  VARIANT (172): Lys, Ser, Ala, Thr, Gly, or Val
  MOD_RES (173): Hydroxyproline
  VARIANT (174): Lys, Ser, Ala, Thr, Gly, or Val
  MOD_RES (175): Hydroxyproline
  VARIANT (176): Lys, Ser, Ala, Thr, Gly, or Val
  MOD_RES (177): Hydroxyproline
  VARIANT (178): Lys, Ser, Ala, Thr, Gly, or Val
  MOD_RES (179): Hydroxyproline
  VARIANT (180): Lys, Ser, Ala, Thr, Gly, or Val
  MOD_RES (181): Hydroxyproline
  VARIANT (182): Lys, Ser, Ala, Thr, Gly, or Val
  MOD_RES (183): Hydroxyproline
  VARIANT (184): Lys, Ser, Ala, Thr, Gly, or Val
  MOD_RES (185): Hydroxyproline
  VARIANT (186): Lys, Ser, Ala, Thr, Gly, or Val
  MOD_RES (187): Hydroxyproline
  VARIANT (188): Lys, Ser, Ala, Thr, Gly, or Val
  MOD_RES (189): Hydroxyproline
  VARIANT (190): Lys, Ser, Ala, Thr, Gly, or Val
  MOD_RES (191): Hydroxyproline
  VARIANT (192): Lys, Ser, Ala, Thr, Gly, or Val
  MOD_RES (193): Hydroxyproline
  VARIANT (194): Lys, Ser, Ala, Thr, Gly, or Val
  MOD_RES (195): Hydroxyproline
  VARIANT (196): Lys, Ser, Ala, Thr, Gly, or Val
  MOD_RES (197): Hydroxyproline
  VARIANT (198): Lys, Ser, Ala, Thr, Gly, or Val
  MOD_RES (199): Hydroxyproline
  VARIANT (200): Lys, Ser, Ala, Thr, Gly, or Val
  This sequence encompasses at least 6-100 (Hyp-Xaa) repeating units, and subject to having the minumum number of repeating units, any one or more repeating units can either be present or absent

SEQ ID NO: 167 - protein, 40 aa, Artificial Sequence
  Description of Artificial Sequence: Synthetic amino acid motif
  VARIANT (1): Lys, Ser, Ala, Thr, Gly, or Val
  MOD_RES (2): Hydroxyproline
  VARIANT (3): Lys, Ser, Ala, Thr, Gly, or Val
  MOD_RES (4): Hydroxyproline
  VARIANT (5): Lys, Ser, Ala, Thr, Gly, or Val
  MOD_RES (6): Hydroxyproline
  VARIANT (7): Lys, Ser, Ala, Thr, Gly, or Val
  MOD_RES (8): Hydroxyproline
  VARIANT (9): Lys, Ser, Ala, Thr, Gly, or Val
  MOD_RES (10): Hydroxyproline
  VARIANT (11): Lys, Ser, Ala, Thr, Gly, or Val
  MOD_RES (12): Hydroxyproline
  VARIANT (13): Lys, Ser, Ala, Thr, Gly, or Val
  MOD_RES (14): Hydroxyproline
  VARIANT (15): Lys, Ser, Ala, Thr, Gly, or Val
  MOD_RES (16): Hydroxyproline
  VARIANT (17): Lys, Ser, Ala, Thr, Gly, or Val
  MOD_RES (18): Hydroxyproline
  VARIANT (19): Lys, Ser, Ala, Thr, Gly, or Val
  MOD_RES (20): Hydroxyproline
  VARIANT (21): Lys, Ser, Ala, Thr, Gly, or Val
  MOD_RES (22): Hydroxyproline
  VARIANT (23): Lys, Ser, Ala, Thr, Gly, or Val
  MOD_RES (24): Hydroxyproline
  VARIANT (25): Lys, Ser, Ala, Thr, Gly, or Val
  MOD_RES (26): Hydroxyproline
  VARIANT (27): Lys, Ser, Ala, Thr, Gly, or Val
  MOD_RES (28): Hydroxyproline
  VARIANT (29): Lys, Ser, Ala, Thr, Gly, or Val
  MOD_RES (30): Hydroxyproline
  VARIANT (31): Lys, Ser, Ala, Thr, Gly, or Val
  MOD_RES (32): Hydroxyproline
  VARIANT (33): Lys, Ser, Ala, Thr, Gly, or Val
  MOD_RES (34): Hydroxyproline
  VARIANT (35): Lys, Ser, Ala, Thr, Gly, or Val
  MOD_RES (36): Hydroxyproline
  VARIANT (37): Lys, Ser, Ala, Thr, Gly, or Val
  MOD_RES (38): Hydroxyproline
  VARIANT (39): Lys, Ser, Ala, Thr, Gly, or Val
  MOD_RES (40): Hydroxyproline
  This sequence encompasses at least 6-20 (Xaa-Hyp) repeating units, and subject to having the minumum number of repeating units, any one or more repeating units can either be present or absent
XXXXXXXXXXXXXXXXXXXXXXXXXXXXXXXXXXXXXXXX

SEQ ID NO: 168 - protein, 40 aa, Artificial Sequence; identical to SEQ ID NO: 167
  Description of Artificial Sequence: Synthetic amino acid motif
  MOD_RES (1): Hydroxyproline
  VARIANT (2): Lys, Ser, Ala, Thr, Gly, or Val
  MOD_RES (3): Hydroxyproline
  VARIANT (4): Lys, Ser, Ala, Thr, Gly, or Val
  MOD_RES (5): Hydroxyproline
  VARIANT (6): Lys, Ser, Ala, Thr, Gly, or Val
  MOD_RES (7): Hydroxyproline
  VARIANT (8): Lys, Ser, Ala, Thr, Gly, or Val
  MOD_RES (9): Hydroxyproline
  VARIANT (10): Lys, Ser, Ala, Thr, Gly, or Val
  MOD_RES (11): Hydroxyproline
  VARIANT (12): Lys, Ser, Ala, Thr, Gly, or Val
  MOD_RES (13): Hydroxyproline
  VARIANT (14): Lys, Ser, Ala, Thr, Gly, or Val
  MOD_RES (15): Hydroxyproline
  VARIANT (16): Lys, Ser, Ala, Thr, Gly, or Val
  MOD_RES (17): Hydroxyproline
  VARIANT (18): Lys, Ser, Ala, Thr, Gly, or Val
  MOD_RES (19): Hydroxyproline
  VARIANT (20): Lys, Ser, Ala, Thr, Gly, or Val
  MOD_RES (21): Hydroxyproline
  VARIANT (22): Lys, Ser, Ala, Thr, Gly, or Val
  MOD_RES (23): Hydroxyproline
  VARIANT (24): Lys, Ser, Ala, Thr, Gly, or Val
  MOD_RES (25): Hydroxyproline
  VARIANT (26): Lys, Ser, Ala, Thr, Gly, or Val
  MOD_RES (27): Hydroxyproline
  VARIANT (28): Lys, Ser, Ala, Thr, Gly, or Val
  MOD_RES (29): Hydroxyproline
  VARIANT (30): Lys, Ser, Ala, Thr, Gly, or Val
  MOD_RES (31): Hydroxyproline
  VARIANT (32): Lys, Ser, Ala, Thr, Gly, or Val
  MOD_RES (33): Hydroxyproline
  VARIANT (34): Lys, Ser, Ala, Thr, Gly, or Val
  MOD_RES (35): Hydroxyproline
  VARIANT (36): Lys, Ser, Ala, Thr, Gly, or Val
  MOD_RES (37): Hydroxyproline
  VARIANT (38): Lys, Ser, Ala, Thr, Gly, or Val
  MOD_RES (39): Hydroxyproline
  VARIANT (40): Lys, Ser, Ala, Thr, Gly, or Val
  This sequence encompasses at least 6-20 (Hyp-Xaa) repeating units, and subject to having the minumum number of repeating units, any one or more repeating units can either be present or absent

SEQ ID NO: 169 - protein, 101 aa, Artificial Sequence; identical to SEQ ID NO: 8
  Description of Artificial Sequence: Synthetic amino acid motif
  VARIANT (1): Ser, Ala, Thr, or Val
  MOD_RES (2)..(101): This region encompasses at least 4 to 100 residues of Hydroxyproline, and subject to having the minumum number of residues, any one or more of amino acid residues 2 to 101 can either be present or absent

SEQ ID NO: 170 - protein, 102 aa, Artificial Sequence; identical to SEQ ID NO: 7
  Description of Artificial Sequence: Synthetic amino acid motif
  VARIANT (1): Ser, Ala, Thr, or Val
  MOD_RES (3)..(102): This region encompasses at least 4 to 100 residues of Hydroxyproline, and subject to having the minumum number of residues, any one or more of amino acid residues 3 to 102 can either be present or absent

SEQ ID NO: 171 - protein, 101 aa, Artificial Sequence; identical to SEQ ID NO: 8
  Description of Artificial Sequence: Synthetic amino acid motif
  MOD_RES (1)..(100): This region encompasses at least 4 to 100 residues of Hydroxyproline, and subject to having the minumum number of residues, any one or more of amino acid residues 1 to 100 can either be present or absent
  VARIANT (101): Ser, Ala, Thr, or Val

SEQ ID NO: 172 - protein, 200 aa, Artificial Sequence; identical to SEQ ID NO: 9
  Description of Artificial Sequence: Synthetic amino acid motif
  MOD_RES (1): Hydroxyproline
  VARIANT (2): Ser, Ala, Thr, or Val
  MOD_RES (3): Hydroxyproline
  VARIANT (4): Ser, Ala, Thr, or Val
  MOD_RES (5): Hydroxyproline
  VARIANT (6): Ser, Ala, Thr, or Val
  MOD_RES (7): Hydroxyproline
  VARIANT (8): Ser, Ala, Thr, or Val
  MOD_RES (9): Hydroxyproline
  VARIANT (10): Ser, Ala, Thr, or Val
  MOD_RES (11): Hydroxyproline
  VARIANT (12): Ser, Ala, Thr, or Val
  MOD_RES (13): Hydroxyproline
  VARIANT (14): Ser, Ala, Thr, or Val
  MOD_RES (15): Hydroxyproline
  VARIANT (16): Ser, Ala, Thr, or Val
  MOD_RES (17): Hydroxyproline
  VARIANT (18): Ser, Ala, Thr, or Val
  MOD_RES (19): Hydroxyproline
  VARIANT (20): Ser, Ala, Thr, or Val
  MOD_RES (21): Hydroxyproline
  VARIANT (22): Ser, Ala, Thr, or Val
  MOD_RES (23): Hydroxyproline
  VARIANT (24): Ser, Ala, Thr, or Val
  MOD_RES (25): Hydroxyproline
  VARIANT (26): Ser, Ala, Thr, or Val
  MOD_RES (27): Hydroxyproline
  VARIANT (28): Ser, Ala, Thr, or Val
  MOD_RES (29): Hydroxyproline
  VARIANT (30): Ser, Ala, Thr, or Val
  MOD_RES (31): Hydroxyproline
  VARIANT (32): Ser, Ala, Thr, or Val
  MOD_RES (33): Hydroxyproline
  VARIANT (34): Ser, Ala, Thr, or Val
  MOD_RES (35): Hydroxyproline
  VARIANT (36): Ser, Ala, Thr, or Val
  MOD_RES (37): Hydroxyproline
  VARIANT (38): Ser, Ala, Thr, or Val
  MOD_RES (39): Hydroxyproline
  VARIANT (40): Ser, Ala, Thr, or Val
  MOD_RES (41): Hydroxyproline
  VARIANT (42): Ser, Ala, Thr, or Val
  MOD_RES (43): Hydroxyproline
  VARIANT (44): Ser, Ala, Thr, or Val
  MOD_RES (45): Hydroxyproline
  VARIANT (46): Ser, Ala, Thr, or Val
  MOD_RES (47): Hydroxyproline
  VARIANT (48): Ser, Ala, Thr, or Val
  MOD_RES (49): Hydroxyproline
  VARIANT (50): Ser, Ala, Thr, or Val
  MOD_RES (51): Hydroxyproline
  VARIANT (52): Ser, Ala, Thr, or Val
  MOD_RES (53): Hydroxyproline
  VARIANT (54): Ser, Ala, Thr, or Val
  MOD_RES (55): Hydroxyproline
  VARIANT (56): Ser, Ala, Thr, or Val
  MOD_RES (57): Hydroxyproline
  VARIANT (58): Ser, Ala, Thr, or Val
  MOD_RES (59): Hydroxyproline
  VARIANT (60): Ser, Ala, Thr, or Val
  MOD_RES (61): Hydroxyproline
  VARIANT (62): Ser, Ala, Thr, or Val
  MOD_RES (63): Hydroxyproline
  VARIANT (64): Ser, Ala, Thr, or Val
  MOD_RES (65): Hydroxyproline
  VARIANT (66): Ser, Ala, Thr, or Val
  MOD_RES (67): Hydroxyproline
  VARIANT (68): Ser, Ala, Thr, or Val
  MOD_RES (69): Hydroxyproline
  VARIANT (70): Ser, Ala, Thr, or Val
  MOD_RES (71): Hydroxyproline
  VARIANT (72): Ser, Ala, Thr, or Val
  MOD_RES (73): Hydroxyproline
  VARIANT (74): Ser, Ala, Thr, or Val
  MOD_RES (75): Hydroxyproline
  VARIANT (76): Ser, Ala, Thr, or Val
  MOD_RES (77): Hydroxyproline
  VARIANT (78): Ser, Ala, Thr, or Val
  MOD_RES (79): Hydroxyproline
  VARIANT (80): Ser, Ala, Thr, or Val
  MOD_RES (81): Hydroxyproline
  VARIANT (82): Ser, Ala, Thr, or Val
  MOD_RES (83): Hydroxyproline
  VARIANT (84): Ser, Ala, Thr, or Val
  MOD_RES (85): Hydroxyproline
  VARIANT (86): Ser, Ala, Thr, or Val
  MOD_RES (87): Hydroxyproline
  VARIANT (88): Ser, Ala, Thr, or Val
  MOD_RES (89): Hydroxyproline
  VARIANT (90): Ser, Ala, Thr, or Val
  MOD_RES (91): Hydroxyproline
  VARIANT (92): Ser, Ala, Thr, or Val
  MOD_RES (93): Hydroxyproline
  VARIANT (94): Ser, Ala, Thr, or Val
  MOD_RES (95): Hydroxyproline
  VARIANT (96): Ser, Ala, Thr, or Val
  MOD_RES (97): Hydroxyproline
  VARIANT (98): Ser, Ala, Thr, or Val
  MOD_RES (99): Hydroxyproline
  VARIANT (100): Ser, Ala, Thr, or Val
  MOD_RES (101): Hydroxyproline
  VARIANT (102): Ser, Ala, Thr, or Val
  MOD_RES (103): Hydroxyproline
  VARIANT (104): Ser, Ala, Thr, or Val
  MOD_RES (105): Hydroxyproline
  VARIANT (106): Ser, Ala, Thr, or Val
  MOD_RES (107): Hydroxyproline
  VARIANT (108): Ser, Ala, Thr, or Val
  MOD_RES (109): Hydroxyproline
  VARIANT (110): Ser, Ala, Thr, or Val
  MOD_RES (111): Hydroxyproline
  VARIANT (112): Ser, Ala, Thr, or Val
  MOD_RES (113): Hydroxyproline
  VARIANT (114): Ser, Ala, Thr, or Val
  MOD_RES (115): Hydroxyproline
  VARIANT (116): Ser, Ala, Thr, or Val
  MOD_RES (117): Hydroxyproline
  VARIANT (118): Ser, Ala, Thr, or Val
  MOD_RES (119): Hydroxyproline
  VARIANT (120): Ser, Ala, Thr, or Val
  MOD_RES (121): Hydroxyproline
  VARIANT (122): Ser, Ala, Thr, or Val
  MOD_RES (123): Hydroxyproline
  VARIANT (124): Ser, Ala, Thr, or Val
  MOD_RES (125): Hydroxyproline
  VARIANT (126): Ser, Ala, Thr, or Val
  MOD_RES (127): Hydroxyproline
  VARIANT (128): Ser, Ala, Thr, or Val
  MOD_RES (129): Hydroxyproline
  VARIANT (130): Ser, Ala, Thr, or Val
  MOD_RES (131): Hydroxyproline
  VARIANT (132): Ser, Ala, Thr, or Val
  MOD_RES (133): Hydroxyproline
  VARIANT (134): Ser, Ala, Thr, or Val
  MOD_RES (135): Hydroxyproline
  VARIANT (136): Ser, Ala, Thr, or Val
  MOD_RES (137): Hydroxyproline
  VARIANT (138): Ser, Ala, Thr, or Val
  MOD_RES (139): Hydroxyproline
  VARIANT (140): Ser, Ala, Thr, or Val
  MOD_RES (141): Hydroxyproline
  VARIANT (142): Ser, Ala, Thr, or Val
  MOD_RES (143): Hydroxyproline
  VARIANT (144): Ser, Ala, Thr, or Val
  MOD_RES (145): Hydroxyproline
  VARIANT (146): Ser, Ala, Thr, or Val
  MOD_RES (147): Hydroxyproline
  VARIANT (148): Ser, Ala, Thr, or Val
  MOD_RES (149): Hydroxyproline
  VARIANT (150): Ser, Ala, Thr, or Val
  MOD_RES (151): Hydroxyproline
  VARIANT (152): Ser, Ala, Thr, or Val
  MOD_RES (153): Hydroxyproline
  VARIANT (154): Ser, Ala, Thr, or Val
  MOD_RES (155): Hydroxyproline
  VARIANT (156): Ser, Ala, Thr, or Val
  MOD_RES (157): Hydroxyproline
  VARIANT (158): Ser, Ala, Thr, or Val
  MOD_RES (159): Hydroxyproline
  VARIANT (160): Ser, Ala, Thr, or Val
  MOD_RES (161): Hydroxyproline
  VARIANT (162): Ser, Ala, Thr, or Val
  MOD_RES (163): Hydroxyproline
  VARIANT (164): Ser, Ala, Thr, or Val
  MOD_RES (165): Hydroxyproline
  VARIANT (166): Ser, Ala, Thr, or Val
  MOD_RES (167): Hydroxyproline
  VARIANT (168): Ser, Ala, Thr, or Val
  MOD_RES (169): Hydroxyproline
  VARIANT (170): Ser, Ala, Thr, or Val
  MOD_RES (171): Hydroxyproline
  VARIANT (172): Ser, Ala, Thr, or Val
  MOD_RES (173): Hydroxyproline
  VARIANT (174): Ser, Ala, Thr, or Val
  MOD_RES (175): Hydroxyproline
  VARIANT (176): Ser, Ala, Thr, or Val
  MOD_RES (177): Hydroxyproline
  VARIANT (178): Ser, Ala, Thr, or Val
  MOD_RES (179): Hydroxyproline
  VARIANT (180): Ser, Ala, Thr, or Val
  MOD_RES (181): Hydroxyproline
  VARIANT (182): Ser, Ala, Thr, or Val
  MOD_RES (183): Hydroxyproline
  VARIANT (184): Ser, Ala, Thr, or Val
  MOD_RES (185): Hydroxyproline
  VARIANT (186): Ser, Ala, Thr, or Val
  MOD_RES (187): Hydroxyproline
  VARIANT (188): Ser, Ala, Thr, or Val
  MOD_RES (189): Hydroxyproline
  VARIANT (190): Ser, Ala, Thr, or Val
  MOD_RES (191): Hydroxyproline
  VARIANT (192): Ser, Ala, Thr, or Val
  MOD_RES (193): Hydroxyproline
  VARIANT (194): Ser, Ala, Thr, or Val
  MOD_RES (195): Hydroxyproline
  VARIANT (196): Ser, Ala, Thr, or Val
  MOD_RES (197): Hydroxyproline
  VARIANT (198): Ser, Ala, Thr, or Val
  MOD_RES (199): Hydroxyproline
  VARIANT (200): Ser, Ala, Thr, or Val
  This sequence encompasses at least 4-100 (Hyp-Xaa) repeating units, and subject to having the minumum number of repeating units, any one or more repeating units can either be present or absent

SEQ ID NO: 173 - protein, 200 aa, Artificial Sequence; identical to SEQ ID NO: 9
  Description of Artificial Sequence: Synthetic amino acid motif
  VARIANT (1): Ser, Ala, Thr, or Val
  MOD_RES (2): Hydroxyproline
  VARIANT (3): Ser, Ala, Thr, or Val
  MOD_RES (4): Hydroxyproline
  VARIANT (5): Ser, Ala, Thr, or Val
  MOD_RES (6): Hydroxyproline
  VARIANT (7): Ser, Ala, Thr, or Val
  MOD_RES (8): Hydroxyproline
  VARIANT (9): Ser, Ala, Thr, or Val
  MOD_RES (10): Hydroxyproline
  VARIANT (11): Ser, Ala, Thr, or Val
  MOD_RES (12): Hydroxyproline
  VARIANT (13): Ser, Ala, Thr, or Val
  MOD_RES (14): Hydroxyproline
  VARIANT (15): Ser, Ala, Thr, or Val
  MOD_RES (16): Hydroxyproline
  VARIANT (17): Ser, Ala, Thr, or Val
  MOD_RES (18): Hydroxyproline
  VARIANT (19): Ser, Ala, Thr, or Val
  MOD_RES (20): Hydroxyproline
  VARIANT (21): Ser, Ala, Thr, or Val
  MOD_RES (22): Hydroxyproline
  VARIANT (23): Ser, Ala, Thr, or Val
  MOD_RES (24): Hydroxyproline
  VARIANT (25): Ser, Ala, Thr, or Val
  MOD_RES (26): Hydroxyproline
  VARIANT (27): Ser, Ala, Thr, or Val
  MOD_RES (28): Hydroxyproline
  VARIANT (29): Ser, Ala, Thr, or Val
  MOD_RES (30): Hydroxyproline
  VARIANT (31): Ser, Ala, Thr, or Val
  MOD_RES (32): Hydroxyproline
  VARIANT (33): Ser, Ala, Thr, or Val
  MOD_RES (34): Hydroxyproline
  VARIANT (35): Ser, Ala, Thr, or Val
  MOD_RES (36): Hydroxyproline
  VARIANT (37): Ser, Ala, Thr, or Val
  MOD_RES (38): Hydroxyproline
  VARIANT (39): Ser, Ala, Thr, or Val
  MOD_RES (40): Hydroxyproline
  VARIANT (41): Ser, Ala, Thr, or Val
  MOD_RES (42): Hydroxyproline
  VARIANT (43): Ser, Ala, Thr, or Val
  MOD_RES (44): Hydroxyproline
  VARIANT (45): Ser, Ala, Thr, or Val
  MOD_RES (46): Hydroxyproline
  VARIANT (47): Ser, Ala, Thr, or Val
  MOD_RES (48): Hydroxyproline
  VARIANT (49): Ser, Ala, Thr, or Val
  MOD_RES (50): Hydroxyproline
  VARIANT (51): Ser, Ala, Thr, or Val
  MOD_RES (52): Hydroxyproline
  VARIANT (53): Ser, Ala, Thr, or Val
  MOD_RES (54): Hydroxyproline
  VARIANT (55): Ser, Ala, Thr, or Val
  MOD_RES (56): Hydroxyproline
  VARIANT (57): Ser, Ala, Thr, or Val
  MOD_RES (58): Hydroxyproline
  VARIANT (59): Ser, Ala, Thr, or Val
  MOD_RES (60): Hydroxyproline
  VARIANT (61): Ser, Ala, Thr, or Val
  MOD_RES (62): Hydroxyproline
  VARIANT (63): Ser, Ala, Thr, or Val
  MOD_RES (64): Hydroxyproline
  VARIANT (65): Ser, Ala, Thr, or Val
  MOD_RES (66): Hydroxyproline
  VARIANT (67): Ser, Ala, Thr, or Val
  MOD_RES (68): Hydroxyproline
  VARIANT (69): Ser, Ala, Thr, or Val
  MOD_RES (70): Hydroxyproline
  VARIANT (71): Ser, Ala, Thr, or Val
  MOD_RES (72): Hydroxyproline
  VARIANT (73): Ser, Ala, Thr, or Val
  MOD_RES (74): Hydroxyproline
  VARIANT (75): Ser, Ala, Thr, or Val
  MOD_RES (76): Hydroxyproline
  VARIANT (77): Ser, Ala, Thr, or Val
  MOD_RES (78): Hydroxyproline
  VARIANT (79): Ser, Ala, Thr, or Val
  MOD_RES (80): Hydroxyproline
  VARIANT (81): Ser, Ala, Thr, or Val
  MOD_RES (82): Hydroxyproline
  VARIANT (83): Ser, Ala, Thr, or Val
  MOD_RES (84): Hydroxyproline
  VARIANT (85): Ser, Ala, Thr, or Val
  MOD_RES (86): Hydroxyproline
  VARIANT (87): Ser, Ala, Thr, or Val
  MOD_RES (88): Hydroxyproline
  VARIANT (89): Ser, Ala, Thr, or Val
  MOD_RES (90): Hydroxyproline
  VARIANT (91): Ser, Ala, Thr, or Val
  MOD_RES (92): Hydroxyproline
  VARIANT (93): Ser, Ala, Thr, or Val
  MOD_RES (94): Hydroxyproline
  VARIANT (95): Ser, Ala, Thr, or Val
  MOD_RES (96): Hydroxyproline
  VARIANT (97): Ser, Ala, Thr, or Val
  MOD_RES (98): Hydroxyproline
  VARIANT (99): Ser, Ala, Thr, or Val
  MOD_RES (100): Hydroxyproline
  VARIANT (101): Ser, Ala, Thr, or Val
  MOD_RES (102): Hydroxyproline
  VARIANT (103): Ser, Ala, Thr, or Val
  MOD_RES (104): Hydroxyproline
  VARIANT (105): Ser, Ala, Thr, or Val
  MOD_RES (106): Hydroxyproline
  VARIANT (107): Ser, Ala, Thr, or Val
  MOD_RES (108): Hydroxyproline
  VARIANT (109): Ser, Ala, Thr, or Val
  MOD_RES (110): Hydroxyproline
  VARIANT (111): Ser, Ala, Thr, or Val
  MOD_RES (112): Hydroxyproline
  VARIANT (113): Ser, Ala, Thr, or Val
  MOD_RES (114): Hydroxyproline
  VARIANT (115): Ser, Ala, Thr, or Val
  MOD_RES (116): Hydroxyproline
  VARIANT (117): Ser, Ala, Thr, or Val
  MOD_RES (118): Hydroxyproline
  VARIANT (119): Ser, Ala, Thr, or Val
  MOD_RES (120): Hydroxyproline
  VARIANT (121): Ser, Ala, Thr, or Val
  MOD_RES (122): Hydroxyproline
  VARIANT (123): Ser, Ala, Thr, or Val
  MOD_RES (124): Hydroxyproline
  VARIANT (125): Ser, Ala, Thr, or Val
  MOD_RES (126): Hydroxyproline
  VARIANT (127): Ser, Ala, Thr, or Val
  MOD_RES (128): Hydroxyproline
  VARIANT (129): Ser, Ala, Thr, or Val
  MOD_RES (130): Hydroxyproline
  VARIANT (131): Ser, Ala, Thr, or Val
  MOD_RES (132): Hydroxyproline
  VARIANT (133): Ser, Ala, Thr, or Val
  MOD_RES (134): Hydroxyproline
  VARIANT (135): Ser, Ala, Thr, or Val
  MOD_RES (136): Hydroxyproline
  VARIANT (137): Ser, Ala, Thr, or Val
  MOD_RES (138): Hydroxyproline
  VARIANT (139): Ser, Ala, Thr, or Val
  MOD_RES (140): Hydroxyproline
  VARIANT (141): Ser, Ala, Thr, or Val
  MOD_RES (142): Hydroxyproline
  VARIANT (143): Ser, Ala, Thr, or Val
  MOD_RES (144): Hydroxyproline
  VARIANT (145): Ser, Ala, Thr, or Val
  MOD_RES (146): Hydroxyproline
  VARIANT (147): Ser, Ala, Thr, or Val
  MOD_RES (148): Hydroxyproline
  VARIANT (149): Ser, Ala, Thr, or Val
  MOD_RES (150): Hydroxyproline
  VARIANT (151): Ser, Ala, Thr, or Val
  MOD_RES (152): Hydroxyproline
  VARIANT (153): Ser, Ala, Thr, or Val
  MOD_RES (154): Hydroxyproline
  VARIANT (155): Ser, Ala, Thr, or Val
  MOD_RES (156): Hydroxyproline
  VARIANT (157): Ser, Ala, Thr, or Val
  MOD_RES (158): Hydroxyproline
  VARIANT (159): Ser, Ala, Thr, or Val
  MOD_RES (160): Hydroxyproline
  VARIANT (161): Ser, Ala, Thr, or Val
  MOD_RES (162): Hydroxyproline
  VARIANT (163): Ser, Ala, Thr, or Val
  MOD_RES (164): Hydroxyproline
  VARIANT (165): Ser, Ala, Thr, or Val
  MOD_RES (166): Hydroxyproline
  VARIANT (167): Ser, Ala, Thr, or Val
  MOD_RES (168): Hydroxyproline
  VARIANT (169): Ser, Ala, Thr, or Val
  MOD_RES (170): Hydroxyproline
  VARIANT (171): Ser, Ala, Thr, or Val
  MOD_RES (172): Hydroxyproline
  VARIANT (173): Ser, Ala, Thr, or Val
  MOD_RES (174): Hydroxyproline
  VARIANT (175): Ser, Ala, Thr, or Val
  MOD_RES (176): Hydroxyproline
  VARIANT (177): Ser, Ala, Thr, or Val
  MOD_RES (178): Hydroxyproline
  VARIANT (179): Ser, Ala, Thr, or Val
  MOD_RES (180): Hydroxyproline
  VARIANT (181): Ser, Ala, Thr, or Val
  MOD_RES (182): Hydroxyproline
  VARIANT (183): Ser, Ala, Thr, or Val
  MOD_RES (184): Hydroxyproline
  VARIANT (185): Ser, Ala, Thr, or Val
  MOD_RES (186): Hydroxyproline
  VARIANT (187): Ser, Ala, Thr, or Val
  MOD_RES (188): Hydroxyproline
  VARIANT (189): Ser, Ala, Thr, or Val
  MOD_RES (190): Hydroxyproline
  VARIANT (191): Ser, Ala, Thr, or Val
  MOD_RES (192): Hydroxyproline
  VARIANT (193): Ser, Ala, Thr, or Val
  MOD_RES (194): Hydroxyproline
  VARIANT (195): Ser, Ala, Thr, or Val
  MOD_RES (196): Hydroxyproline
  VARIANT (197): Ser, Ala, Thr, or Val
  MOD_RES (198): Hydroxyproline
  VARIANT (199): Ser, Ala, Thr, or Val
  MOD_RES (200): Hydroxyproline
  This sequence encompasses at least 4-100 (Xaa-Hyp) repeating units, and subject to having the minumum number of repeating units, any one or more repeating units can either be present or absent

What is claimed is:

1. A plant-derived biologically active fusion glycoprotein, comprising: a) at least one plant hydroxyproline O-glycosylation glycomodule covalently linked to b) the C-terminus of a biologically active mammalian protein;
   wherein the at least one plant hydroxyproline O-glycosylation glycomodule is (X-Hyp)$_n$ (SEQ ID NO: 3), where n is 2-25 and X is serine, alanine, threonine, or valine; and
   wherein the biologically active fusion glycoprotein exhibits a pharmacokinetic plasma half-life that is increased as compared with the biologically active mammalian protein lacking the at least one plant hydroxyproline O-glycosylation glycomodule; and
   wherein the biologically active mammalian protein is human growth hormone, a human growth hormone variant, human interferon-alpha 2.

2. The plant-derived biologically active fusion glycoprotein according to claim 1, wherein the biologically active mammalian protein is human growth hormone, and the at least one plant hydroxyproline O-glycosylation glycomodule comprises (Ser-Hyp)$_{10}$ (SEQ ID NO: 4).

3. The plant-derived biologically active fusion glycoprotein according to claim 1, wherein the biologically active fusion glycoprotein is covalently linked to at least one carbohydrate molecule.

4. The plant-derived biologically active fusion glycoprotein according to claim 1, wherein the human growth hormone variant has at least 80% amino acid sequence identity to human growth hormone having an amino acid sequence corresponding to the amino acid sequence from the phenylalanine at residue 25 to the phenylalanine at residue 215 of SEQ ID NO: 46.

5. The plant-derived biologically active fusion glycoprotein according to claim 4, wherein the human growth hormone variant is a human growth hormone agonist.

6. The plant-derived biologically active fusion glycoprotein according to claim 4, wherein the human growth hormone variant is a human growth hormone antagonist.

7. The plant-derived biologically active fusion glycoprotein according to claim 6, wherein the human growth hormone variant is a human growth hormone antagonist in which the glycine at residue 144 of SEQ ID NO: 46 is replaced by an amino acid other than alanine.

8. A plant-derived biologically active fusion glycoprotein comprising human growth hormone covalently attached to at least one plant arabinogalactan glycosylation glycomodule, the biologically active fusion glycoprotein exhibiting a pharmacokinetic plasma half-life that is increased by at least about 500% as compared to human growth hormone lacking the at least one plant arabinogalactan glycosylation glycomodule;
   wherein the at least one plant arabinogalactan glycosylation glycomodule is covalently attached to the C-terminus of the human growth hormone;
   wherein the at least one plant arabinogalactan glycosylation glycomodule is the hydroxyproline O-arabinogalactan glycosylated amino acid sequence (Ser-Hyp)$_n$ (SEQ ID NO: 113), where n is 2-20; and
   wherein the expressed biologically active fusion glycoprotein has a carbohydrate component accounting for greater than or equal to about 10% of the molecular weight of the biologically active fusion glycoprotein.

9. A plant-derived biologically active fusion glycoprotein comprising a human growth hormone variant having at least 80% amino acid sequence identity to human growth hormone having an amino acid sequence corresponding to the amino acid sequence from the phenylalanine at residue 25 to the phenylalanine at residue 215 of SEQ ID NO: 46, the human growth hormone variant being covalently attached to at least one plant arabinogalactan glycosylation glycomodule, the biologically active fusion glycoprotein exhibiting a pharmacokinetic plasma half-life that is increased by at least about 500% as compared to human growth hormone variant lacking the at least one plant arabinogalactan glycosylation glycomodule;
   wherein the at least one plant arabinogalactan glycosylation glycomodule is covalently attached to the C-terminus of the human growth hormone variant;
   wherein the at least one plant arabinogalactan glycosylation glycomodule is the hydroxyproline O-arabinogalactan glycosylated amino acid sequence (X-Hyp)$_n$ (SEQ ID NO: 3), where n is 2-25 and X is Ser, Ala, Thr, or Val; and
   wherein the expressed biologically active fusion glycoprotein has a carbohydrate component accounting for greater than or equal to about 10% of the molecular weight of the biologically active fusion glycoprotein.

10. The plant-derived biologically active fusion glycoprotein according to claim 9, wherein the human growth hormone variant is a human growth hormone agonist.

11. The plant-derived biologically active fusion glycoprotein according to claim 9, wherein the human growth hormone variant is a human growth hormone antagonist.

12. The plant-derived biologically active fusion glycoprotein according to claim 11, wherein the human growth hormone variant is a human growth hormone antagonist in which the glycine at residue 144 of SEQ ID NO: 46 is replaced by an amino acid other than alanine.

13. The plant-derived biologically active fusion glycoprotein according to claim 1, wherein the yield of the biologically active fusion glycoprotein is increased by at least about 1000% as compared with the biologically active mammalian protein lacking the at least one plant hydroxyproline O-glycosylation glycomodule.

14. The plant-derived biologically active fusion glycoprotein according to claim 1, wherein the biologically active fusion glycoprotein exhibits a carbohydrate component accounting for greater than or equal to about 10% of the molecular weight of the biologically active fusion glycoprotein.

15. The plant-derived biologically active fusion glycoprotein according to claim 1, wherein the biologically active fusion glycoprotein exhibits an increased resistance to proteolytic degradation as compared with the same biologically active mammalian protein that lacks the at least one plant hydroxyproline O-glycosylation glycomodule.

16. The plant-derived biologically active fusion glycoprotein according to claim 1, wherein the biologically active fusion glycoprotein exhibits an immunogenicity that is about the same as the biologically active mammalian protein that lacks the at least one plant hydroxyproline O-glycosylation glycomodule.

17. The plant-derived biologically active fusion glycoprotein according to claim 1, wherein:
the pharmacokinetic plasma half-life is increased by at least about 500% as compared with the biologically active mammalian protein lacking the at least one plant hydroxyproline O-glycosylation glycomodule; and
the biologically active fusion glycoprotein exhibits an activity that is about the same as the biologically active mammalian protein lacking the at least one plant hydroxyproline O-glycosylation glycomodule.

18. The plant-derived biologically active fusion glycoprotein according to claim 17, wherein:
the biologically active mammalian protein is human growth hormone;
the at least one plant hydroxyproline O-glycosylation glycomodule comprises (Ser-Hyp)$_{10}$ (SEQ ID NO: 4);
the biologically active fusion glycoprotein is covalently linked to at least one carbohydrate molecule; and
the at least one carbohydrate molecule comprises an arabinogalactan moiety.

19. The plant-derived biologically active fusion glycoprotein according to claim 1, wherein:
the biologically active mammalian protein is human growth hormone;
the at least one plant hydroxyproline O-glycosylation glycomodule comprises (Ser-Hyp)$_{10}$ (SEQ ID NO: 4);
the biologically active fusion glycoprotein is covalently linked to at least one carbohydrate molecule; and
the at least one carbohydrate molecule comprises an arabinogalactan moiety.

20. The plant-derived biologically active fusion glycoprotein according to claim 8, wherein the biologically active fusion glycoprotein exhibits an activity that is about the same as the biologically active mammalian protein lacking the at least one plant hydroxyproline O-glycosylation glycomodule.

* * * * *

UNITED STATES PATENT AND TRADEMARK OFFICE
CERTIFICATE OF CORRECTION

PATENT NO. : 8,962,811 B2  
APPLICATION NO. : 13/855946  
DATED : February 24, 2015  
INVENTOR(S) : Marcia J. Kieliszewski et al.

It is certified that error appears in the above-identified patent and that said Letters Patent is hereby corrected as shown below:

IN THE SPECIFICATION

Col. 6, Line 13,
"FIG. 19 shows the gene sequence of $SS^{tob}$-hGH-(SP)/con-" should read
--FIG. 19 shows the gene sequence of $SS^{tob}$-hGH-$(SP)_1$con- --;

Col. 10, Line 64,
"its 4-o-methyl derivative. Arabinogalactan-polysaccharides" should read
--its 4-*o*-methyl derivative. Arabinogalactan-polysaccharides--;

Col. 12, Line 19,
"yproline, or hyp, or O (in single letter form). Thus, once the" should read
--yproline, or Hyp, or O (in single letter form). Thus, once the--;

Col. 16, Lines 34-35 – duplicate wording
"tensin, oxytocin, pancreatic polypeptide, pancreatic polypeptide, pancreastin, pancreastatin, parathyroid hormone, secre-" should read
--tensin, oxytocin, pancreatic polypeptide, pancreastin, pancreastatin, parathyroid hormone, secre- --;

Col. 17, Line 9,
"HGH modified in accordance with the present invention" should read
--hGH modified in accordance with the present invention--;

Col. 17, Line 28,
"Of course, similar constructs can be created with a 20-kD" should read
--Of course, similar constructs can be created with a 20-kDa--;

Signed and Sealed this
Tenth Day of May, 2016

Michelle K. Lee
*Director of the United States Patent and Trademark Office*

CERTIFICATE OF CORRECTION (continued)
U.S. Pat. No. 8,962,811 B2

IN THE SPECIFICATION

Col. 17, Line 45,
"The following more general description of is informative" should read
--The following more general description is informative--;

Col. 18, Line 31,
"GH-PRL_PL superfamily, the mutant polypeptide sequence" should read
--GH-PRL-PL superfamily, the mutant polypeptide sequence--;

Col. 21, Line 9,
"(6) the differences are limited are limited to substitutions" should read
--(6) the differences are limited to substitutions--;

Col. 22, Line 43,
"HGH as the reference vertebrate GH." should read
--hGH as the reference vertebrate GH.--;

Col. 22, Line 62,
"erence vertebrate growth hormone and the another reference" should read
--reference vertebrate growth hormone and another reference--;

Col. 24, Lines 30-31,
"mature HGH, the best E value was that for the alignment of the mature HGH with the database HGH precursor (ref" should read
--mature hGH, the best E value was that for the alignment of the mature hGH with the database hGH precursor (ref--;

Col. 26, Line 25,
"Molec. Biol., 328: 1105-221 (2003). In Keeler's Fig. 1, HGH" should read
--Molec. Biol., 328: 1105-221 (2003). In Keeler's Fig. 1, hGH--;

Col. 26, Line 40,
"ZnCl2 the affinity is reduced (KD of 1.6 nM). It also reports" should read
--$ZnCl_2$ the affinity is reduced (Kd of 1.6 nM). It also reports--;

Col. 26, Line 42,
"(KD > 100,000 nM whether in presence of EDTA or ZnCl2," should read
--(Kd > 100,000 nM whether in presence of EDTA or $ZnCl_2$,--;

Col. 26, Line 67,
"I4, L6, L9, N12, L15, r16, R19, Q22, Y103, N109, D116," should read
--I4, L6, L9, N12, L15, R16, R19, Q22, Y103, N109, D116,--;

CERTIFICATE OF CORRECTION (continued)
U.S. Pat. No. 8,962,811 B2

IN THE SPECIFICATION

Col. 27, Lines 4 and 5,
"According to the X-ray structure of the hgh(hGHbp)$_2$ complex, the two HGHbp's contact each other at Ser201. Conse-" should read
--According to the X-ray structure of the hGH(hGHbp)$_2$ complex, the two hGHbp's contact each other at Ser201. Conse- --;

Col. 27, Line 14,
"presence of ZnCl2 the affinity is reduced (KD of 2.6 nM)." should read
--presence of ZnCl$_2$ the affinity is reduced (Kd of 2.6 nM).--;

Col. 27, Lines 20 and 21,
"such that the Kd is 270 nM, while in the presence of ZnCl2 the affinity is substantially increased (KD of 0.033 nM, i.e., 33" should read
--such that the Kd is 270 nM, while in the presence of ZnCl$_2$ the affinity is substantially increased (Kd of 0.033 nM, i.e., 33--;

Col. 27, Line 28,
"residues F25 and D26), a loop region (including 158 and" should read
--residues F25 and D26), a loop region (including I58 and--;

Col. 28, Line 1,
"hPRLbp in presence of ZnCl2 are given in Tables 7-9. WO92/" should read
--hPRLbp in presence of ZnCl$_2$ are given in Tables 7-9. WO92/--;

Col. 28, Line 5,
"The affinity of hPL for hPRLbp in the presence of ZnCl2 is" should read
--The affinity of hPL for hPRLbp in the presence of ZnCl$_2$ is--;

Col. 31, Line 40,
"tested was the tetramutant (F54P, E56D, 158T, R64K), which" should read
--tested was the tetramutant (F54P, E56D, I58T, R64K), which--;

Col. 35, Line 26,
"Q66E. The additional mutation L1791 did not alter the affin-" should read
--Q66E. The additional mutation L179I did not alter the affin- --;

Col. 35, Line 36,
"R16Q, E56D, R64M, and I1179M, where, e.g., "P2Q" means" should read
--R16Q, E56D, R64M, and I179M, where, e.g., "P2Q" means--;

Col. 45, Line 19,
"more closely resembles the native GAGP. The [Gum]$_z$ gene" should read
--more closely resembles the native GAGP. The [Gum]$_2$ gene--;

CERTIFICATE OF CORRECTION (continued)
U.S. Pat. No. 8,962,811 B2

IN THE SPECIFICATION

Col. 45, Line 26,
"BsrFI) of [Gum]$_Z$ fragment to generate double number of" should read
--BsrFI) of [Gum]$_2$ fragment to generate double number of--;

Col. 50, Line 41,
"(SO$_{10}$ ((SO)$_{10}$ disclosed as SEQ ID NO: 4). The tobacco cells" should read
--(SO)$_{10}$ ((SO)$_{10}$ disclosed as SEQ ID NO: 4). The tobacco cells--;

Col. 64, Line 3,
"stopped by addition of 500/well 12.5% sulfuric acid when" should read
--stopped by addition of 50μl/well 12.5% sulfuric acid when--; and Col. 64, Line 17,
"hGH-SP10 conjugate antigen even before immunization." should read
--hGH-SP$_{10}$ conjugate antigen even before immunization.--.